(12) United States Patent
Linden et al.

(10) Patent No.: US 11,840,689 B2
(45) Date of Patent: Dec. 12, 2023

(54) METHOD OF TREATING FATTY LIVER DISEASE

(71) Applicants: ASTRAZENECA AB, Södertälje (SE); IONIS PHARMACEUTICLS, INC., Carlsbad, CA (US)

(72) Inventors: Daniel Linden, Södertälje (SE); Richard Lee, Carlsbad, CA (US); Stefano Romeo, Göthenburg (SE); Huynh-Hoa Bui, Carlsbad, CA (US)

(73) Assignees: ASTRAZENECA AB, Södertälje (SE); IONIS PHARMACEUTICALS, INC., Carisbad, CA (US)

( * ) Notice: Subject to any disclaimer, the term of this patent is extended or adjusted under 35 U.S.C. 154(b) by 0 days.

(21) Appl. No.: 17/480,266

(22) Filed: Sep. 21, 2021

(65) Prior Publication Data
US 2022/0090072 A1 Mar. 24, 2022

Related U.S. Application Data

(60) Provisional application No. 63/081,633, filed on Sep. 22, 2020.

(51) Int. Cl.
| | |
|---|---|
| *C07H 21/04* | (2006.01) |
| *C12N 15/113* | (2010.01) |
| *A61P 1/16* | (2006.01) |
| *A61K 31/713* | (2006.01) |

(52) U.S. Cl.
CPC .......... *C12N 15/113* (2013.01); *A61K 31/713* (2013.01); *A61P 1/16* (2018.01); *C12N 2310/14* (2013.01); *C12N 2310/141* (2013.01); *C12N 2310/315* (2013.01); *C12N 2310/321* (2013.01); *C12N 2310/322* (2013.01); *C12N 2310/341* (2013.01); *C12N 2310/3519* (2013.01)

(58) Field of Classification Search
None
See application file for complete search history.

(56) References Cited

U.S. PATENT DOCUMENTS

2018/0214578 A1   8/2018   Ko et al.

FOREIGN PATENT DOCUMENTS

WO   2011141703 A1   11/2011

OTHER PUBLICATIONS

Cansby Emmelie et al.: "Targeted delivery of Stk25 antisense oligonucleotides to hepatocytes protects mice against nonalcoholic fatty liver disease", CMGH Cellular and Molecular Gastroenterology and Hepatology, vol. 7, No. 3, Jan. 1, 2019 (Jan. 1, 2019) pp. 597-618.
Mancina Rosellina M. et al.: "PSD3 downregulation confers protection against fatty liver disease", Nature Metabolism, vol. 4, No. 1, Jan. 1, 2022 (Jan. 1, 2022) , pp. 60-75.
Morral N. et al.: "Inhibition of hepatic de novo lipogenesis to reduce fatty liver: effects of SREBP-1 gene silencing", Journal of Hepatology, vol. 56, 2012, pp. S494-S495.
Nunez Duran Esther et al.: "Serine/Threonine Protein Kinase 25 antisense oligonucleotide treatment reverses glucose intolerance, insulin resistance, and nonalcoholic fatty liver disease in mice", Hepatology Communications, vol. 2, No. 1 Jan. 1, 2018 (Jan. 1, 2018).
Zhao Ying-Peng et al.: "LXR[alpha] gene downregulation by lentiviral-based RNA interference enhances liver function after fatty liver transplantation in rats", Hepatobiliary & Pancreatic Diseases International, vol. 14, No. 4, Mar. 10, 2015 (Mar. 10, 2015) , pp. 386-393.
International Search Report for International Application No. PCT/EP2021/075952, dated Mar. 11, 2022.
Gong, S. et al.,"Genetic association analysis of polymorphisms in PSD3 gene with obesity, type 2 diabetes, and HDL cholesterol," Diabetes Research and Clinical Practice, 126:105-114 (2017).
Bu, F. et al., "Circular RNA circPSD3 alleviates hepatic fibrogenesis by regulating the mrR-92b-3p/Smad7 axis," Molecular Therapy Nucleic Acids, 23:847-862 (2021).
Samuel, VT et al., "The pathogenesis of insulin resistance," The Journal of Clinical Investigation, 126(1):12-22 (2016).

*Primary Examiner* — Kimberly Chong

(57) ABSTRACT

The present disclosure provides methods of treating or preventing fatty liver disease and/or lowering cholesterol and LDL cholesterol levels in a subject. The present disclosure further provides methods of lowering expression of Pleckstrin and Sec7 Domain Containing 3 (PSD3) in a subject.

7 Claims, 29 Drawing Sheets
Specification includes a Sequence Listing.

| Locus | Tag SNP | Lead trait | Other traits |
|---|---|---|---|
| ANGPTL3 | rs2131925 | TG | TC, LDL |
| GALNT2 | rs4846914 | HDL | TG |
| APOB | rs1042034 | TG | HDL |
| GCKR | rs1260326 | TG | TC |
| COBLL1/LOC101929615/GRB14 | rs10195252 | TG | |
| IRS1/CUL3 | rs2972146 | HDL | TG |
| MSL2L1/PCCB | rs645040 | TG | |
| KLHL8 | rs442177 | TG | |
| MAP3K1 | rs9686661 | TG | |
| TIMD4 | rs6882076 | TC | LDL, TG |
| HLA/WASF5P | rs2247056 | TG | |
| TYW1B | rs13238203 | TG | |
| MLXIPL/TBL2/BCL7B | rs17145738 | TG | HDL |
| PINX1 | rs11776767 | TG | |
| NAT2/PSD3 | rs1495741 | TG | TC |
| LPL/SLC18A1 | rs12678919 | TG | HDL |
| TRIB1/LOC101927634 | rs2954029 | TG | TC, LDL, HDL |
| JMJD1C | rs10761731 | TG | |
| CYP26A1/NIP7P1 | rs2068888 | TG | |
| FADS1-2-3 | rs174546 | TG | HDL, TC, LDL |
| APOA1 | rs964184 | TG | TC, HDL, LDL |
| LRP1 | rs11613352 | TG | HDL |
| ZNF664 | rs4765127 | HDL | TG |
| CAPN3 | rs2412710 | TG | |
| FRMD5 | rs2929282 | TG | |
| LIPC | rs1532085 | HDL | TC, TG |
| CTF1 | rs11649653 | TG | |
| CETP/HERPUD1 | rs3764261 | HDL | TC, LDL, TG |
| CILP2/TM6SF2/SUGP1 | rs10401969 | TC | TG, LDL |
| APOE/APOC1 | rs439401 | TG | |
| PLTP/PCIF1 | rs6065906 | HDL | TG |
| PLA2G6 | rs5756931 | TG | |

FIG. 1

| Chr | Position | rsID | Gene | Amino acid substitution | Nucleotide substitution | N0 | N1 | N2 | MAF^ | MAF EUR^^ | P-value | Beta | SE |
|---|---|---|---|---|---|---|---|---|---|---|---|---|---|
| 2 | 27730940 | rs1260326 | GCKR* | L446P | G/A | 1,515 | 972 | 247 | 27% | 41% | 0.007 | 0.03 | 0.01 |
| 8 | 18872307-08 | rs71519934 | PSD3 | L186T | AC/CT | 1,907 | 728 | 101 | 17% | 33% | 0.049 | -0.02 | 0.01 |
| 19 | 19379549 | rs58542926 | TM6SF2 | E167K | G/A | 2,470 | 259 | 7 | 5% | 7% | $5.7 \times 10^{-8}$ | 0.12 | 0.02 |

FIG. 2

| | | |
|---|---|---|
| Liver Biopsy Cohort | N | 1,951 |
| Anthropometrical traits | Age, years | 47±12 |
| | Male gender, n(%) | 909(47) |
| | BMI, Kg/m2 | 37±9 |
| Metabolic traits | Diabetes presence, n(%) | 507(26) |
| | Total cholesterol, mmol/L | 4.90±1.14 |
| | HDL, mmol/L | 1.25±0.36 |
| | LDL, mmol/L | 2.93±0.99 |
| | Triglycerides, mmol/L | 1.35(0.99-1.91) |
| | ALT, UI/L | 38(23-63) |
| Liver histology | Steatosis presence, n(%) | 1551(79) |
| | Fibrosis presence, n(%) | 1074(55) |
| | Inflammation presence, n(%) | 1134(58) |
| | Ballooning presence*, n(%) | 652(36) |
| Recruitment centre | Kuopio, Finland, n(%) | 410(21) |
| | Helsinki, Finland, n(%) | 145(7) |
| | Palermo, Italy, n(%) | 374(19) |
| | Milan, Italy n(%) | 1022(52) |
| Central European Cohort | N | 674 |
| Anthropometrical traits | Age, years | 45±12 |
| | Male gender, n(%) | 236(35) |
| | BMI, Kg/m2 | 46±10 |
| Metabolic traits | Diabetes presence, n(%) | 192(31) |
| | Total cholesterol, mmol/L | - |
| | HDL, mmol/L | - |
| | LDL, mmol/L | - |
| | Triglycerides, mmol/L | - |
| | ALT, UI/L | 29(20-46) |
| Liver histology | Steatosis presence, n(%) | 549(81) |
| | Fibrosis presence, n(%) | 255(38) |
| | Inflammation presence, n(%) | 212(31) |
| | Ballooning presence, n(%) | 196(29) |
| Recruitment centre | Germany, n(%) | 559(83) |
| | Austria, n(%) | 83(12) |
| | Switzerland, n(%) | 32(5) |

FIG. 3

|  | P-value | OR | CI | |
|---|---|---|---|---|
| Steatosis presence | 5.9 x 10$^{-6}$ | 0.67 | 0.57 | 0.80 |
| Fibrosis presence | 0.006 | 0.82 | 0.72 | 0.94 |
| Inflammation presence | 9.9 x 10$^{-7}$ | 0.70 | 0.61 | 0.81 |
| Ballooning presence* | 0.002 | 0.79 | 0.68 | 0.92 |

FIG. 4

|  | P-value | OR | CI | |
|---|---|---|---|---|
| Disease presence | | | | |
| Steatosis | 0.024 | 0.69 | 0.50 | 0.95 |
| Fibrosis | 0.049 | 0.77 | 0.59 | 1.00 |
| Inflammation | 0.524 | 0.92 | 0.70 | 1.20 |
| Ballooning | 0.047 | 0.75 | 0.56 | 1.00 |
| Disease severity | | | | |
| Steatosis | 0.158 | 0.85 | 0.69 | 1.06 |
| Fibrosis | 0.040 | 0.77 | 0.60 | 0.99 |
| Inflammation | 0.355 | 0.88 | 0.68 | 1.15 |
| Ballooning | 0.048 | 0.75 | 0.57 | 1.00 |

FIG. 6

| Liver biopsy cohort | 186L | L186T | 186T | P-value |
|---|---|---|---|---|
| N | 917 | 796 | 238 | |
| Age, years | 47±13 | 47±12 | 48±13 | 0.101 |
| Male gender, n(%) | 434(47) | 376(47) | 99(42) | 0.218 |
| BMI, Kg/m2 | 35.7±9.0 | 37.1±8.8 | 38.2±8.9 | $2.1 \times 10^{-5}$ |
| Diabetes presence, n(%) | 222(24) | 212(27) | 73(31) | 0.571 |
| Total cholesterol, mmol/L | 5.08±1.13 | 4.78±1.14 | 4.62±1.09 | $1.4 \times 10^{-6}$ |
| HDL, mmol/L | 1.29±0.39 | 1.22±0.33 | 1.2±0.33 | 0.001 |
| LDL, mmol/L | 3.05±0.99 | 2.86±0.98 | 2.71±0.94 | 0.001 |
| Triglycerides, mmol/L | 1.35(0.99-1.91) | 1.36(1.00-1.96) | 1.32(0.98-1.85) | 0.828 |
| ALT, UI/L | 39(23-66) | 38(23-61) | 37(24-58) | 0.173 |
| | | | | |
| Central European cohort | | | | |
| N | 330 | 282 | 62 | |
| Age, years | 44±13 | 46±12 | 43±12 | 0.955 |
| Male gender, n(%) | 111(34) | 102(36) | 23(37) | 0.469 |
| BMI, Kg/m2 | 46±9 | 46±11 | 45±11 | 0.837 |
| Diabetes presence, n(%) | 89(30) | 82(32) | 21(36) | 0.295 |
| Total cholesterol, mmol/L | - | - | - | - |
| HDL, mmol/L | - | - | - | - |
| LDL, mmol/L | - | - | - | - |
| Triglycerides, mmol/L | - | - | - | - |
| ALT, UI/L | 31(21-46) | 28(19-45) | 27(20-44) | 0.985 |

FIG. 7

| Steatosis Severity | P | OR | CI | |
|---|---|---|---|---|
| LBC | 3,3E-07 | 0,729 | 0,645 | 0,823 |
| Replication | 0,158 | 0,850 | 0,690 | 1,060 |
| | | | | |
| *Meta analyses* | | | | |
| Fixed-effect | 2,4E-07 | 0,755 | 0,678 | 0,840 |
| Random-effects | 1,24E-04 | 0,763 | 0,665 | 0,876 |

| Fibrosis severity | P | OR | CI | |
|---|---|---|---|---|
| LBC | 0,001 | 0,811 | 0,715 | 0,921 |
| Replication | 0,04 | 0,770 | 0,600 | 0,990 |
| | | | | |
| *Meta analyses* | | | | |
| Fixed-effect | 1,13E-04 | 0,803 | 0,718 | 0,898 |
| Random-effects | 1,13E-04 | 0,803 | 0,718 | 0,898 |

| Inflammation severity | P | OR | CI | |
|---|---|---|---|---|
| LBC | 1,6E-07 | 0,711 | 0,626 | 0,807 |
| Replication | 0,355 | 0,880 | 0,680 | 1,150 |
| | | | | |
| *Meta analyses* | | | | |
| Fixed-effect | 2,81E-07 | 0,739 | 0,659 | 0,829 |
| Random-effects | 0,008 | 0,764 | 0,627 | 0,931 |

| Balooning severity | P | OR | CI | |
|---|---|---|---|---|
| LBC | 0,001 | 0,777 | 0,669 | 0,902 |
| Replication | 0,048 | 0,750 | 0,570 | 1,000 |
| | | | | |
| *Meta analyses* | | | | |
| Fixed-effect | 1,27E-04 | 0,771 | 0,675 | 0,881 |
| Random-effects | 1,27E-04 | 0,771 | 0,675 | 0,881 |

FIG. 8A

| Steatosis Presence | P | OR | CI | |
|---|---|---|---|---|
| LBC | 5,90E-06 | 0,670 | 0,570 | 0,800 |
| Replication | 0,024 | 0,690 | 0,500 | 0,950 |
| | | | | |
| *Meta analyses* | | | | |
| Fixed-effect | 4,22E-07 | 0,674 | 0,579 | 0,786 |
| Random-effects | 4,22E-07 | 0,674 | 0,579 | 0,786 |

| Fibrosis presence | P | OR | CI | |
|---|---|---|---|---|
| LBC | 0,006 | 0,820 | 0,720 | 0,940 |
| Replication | 0,049 | 0,770 | 0,590 | 1,000 |
| | | | | |
| *Meta analyses* | | | | |
| Fixed-effect | 7,95E-04 | 0,808 | 0,714 | 0,915 |
| Random-effects | 7,95E-04 | 0,808 | 0,714 | 0,915 |

| Inflammation presence | P | OR | CI | |
|---|---|---|---|---|
| LBC | 9,90E-07 | 0,700 | 0,610 | 0,810 |
| Replication | 0,524 | 0,920 | 0,700 | 1,200 |
| | | | | |
| *Meta analyses* | | | | |
| Fixed-effect | 4,53E-06 | 0,747 | 0,659 | 0,846 |
| Random-effects | 0,073 | 0,785 | 0,603 | 1,023 |

| Balooning presence | P | OR | CI | |
|---|---|---|---|---|
| LBC | 0,002 | 0,790 | 0,680 | 0,920 |
| Replication | 0,047 | 0,750 | 0,560 | 1,000 |
| | | | | |
| *Meta analyses* | | | | |
| Fixed-effect | 2,52E-04 | 0,781 | 0,684 | 0,892 |
| Random-effects | 2,52E-04 | 0,781 | 0,684 | 0,892 |

FIG. 8B

|  | P-value | OR | CI | |
|---|---|---|---|---|
| Steatosis severity | 2.2E-06 | 0.74 | 0.65 | 0.84 |
| Fibrosis severity | 0.002 | 0.82 | 0.71 | 0.93 |
| Inflammation severity | 2.3E-06 | 0.73 | 0.64 | 0.83 |
| Ballooning* severity | 0.003 | 0.79 | 0.68 | 0.92 |

FIG. 16

| Characteristic | 186L | L186T | 186T | P-value |
|---|---|---|---|---|
| All ethnicities | | | | |
| N | 1907 | 728 | 101 | |
| Age, years | 45.6 ± 10.2 | 45.4 ± 10.4 | 47.5 ± 9.5 | 0.59 |
| Female, n (%) | 1077 (56.48) | 403 (55.36) | 53 (52.48) | 0.67 |
| BMI, kg/m^2 | 30.2 ± 6.8 | 30.2 ± 6.6 | 28.1 ± 6.1 | 0.49 |
| TC, mg/dL | 184.5 ± 40.9 | 184.2 ± 36.6 | 182.1 ± 39.1 | 0.18 |
| LDL, mg/dL | 109.7 ± 37.1 | 109 ± 33.9 | 108.9 ± 34.1 | 0.39 |
| HDL, mg/dL | 51 ± 14.9 | 49.8 ± 14.8 | 50.4 ± 15.4 | 0.69 |
| TG, mg/dL | 96 (68 - 144) | 104 (73 - 155) | 101 (72 - 140) | 0.32 |
| HTGC, % | 3.49 (1.97 - 6.78) | 3.74 (1.95 - 7.5) | 3.01 (1.43 - 7.29) | 0.049 |
| African Americans | | | | |
| N | 1096 | 224 | 8 | |
| Age, years | 46.5 ± 10.1 | 45.8 ± 10.5 | 49.1 ± 11.7 | 0.52 |
| Female, n (%) | 642 (58.58) | 142 (63.39) | 3 (37.5) | 0.19 |
| BMI, kg/m^2 | 30.9 ± 7.2 | 31.9 ± 7.6 | 33.1 ± 7.9 | 0.072 |
| TC, mg/dL | 182.8 ± 41.2 | 181.9 ± 38.3 | 196.4 ± 42 | 0.78 |
| LDL, mg/dL | 109.4 ± 38.4 | 107.4 ± 36 | 120.8 ± 47.1 | 0.66 |
| HDL, mg/dL | 53 ± 15.5 | 53.4 ± 14.8 | 54.9 ± 29.1 | 0.41 |
| TG, mg/dL | 86 (63 - 121) | 84 (66 - 128) | 95 (78 - 136) | 0.43 |
| HTGC, % | 3.2 (1.78 - 5.43) | 3.1 (1.7 - 5.08) | 5.39 (1.85 - 10.91) | 0.57 |
| European Americans | | | | |
| N | 457 | 344 | 81 | |
| Age, years | 46.7 ± 10.5 | 46.9 ± 10.1 | 47.3 ± 9.4 | 0.66 |
| Female, n (%) | 236 (51.64) | 170 (49.42) | 45 (55.56) | 0.58 |
| BMI, kg/m^2 | 28.6 ± 5.8 | 29.4 ± 6.1 | 27.7 ± 5.9 | 0.99 |
| TC, mg/dL | 189.9 ± 39.5 | 186.2 ± 35.7 | 179.2 ± 38.4 | 0.012 |
| LDL, mg/dL | 112.5 ± 36 | 110.7 ± 33.9 | 106.8 ± 32.3 | 0.20 |
| HDL, mg/dL | 50.1 ± 15.1 | 48.8 ± 15.4 | 49.6 ± 13.6 | 0.25 |
| TG, mg/dL | 113 (75 - 173) | 112 (79 - 164) | 101 (70 - 145) | 0.11 |
| HTGC, % | 3.64 (2.09 - 7.42) | 3.83 (2.02 - 7.98) | 2.64 (1.28 - 5.51) | 0.073 |
| Hispanics | | | | |
| N | 308 | 149 | 8 | |
| Age, years | 41 ± 8.8 | 41.3 ± 9.5 | 49.6 ± 9.4 | 0.16 |
| Female, n (%) | 184 (59.74) | 86 (57.72) | 4 (50) | 0.78 |
| BMI, kg/m^2 | 30.4 ± 6.5 | 29.8 ± 5.5 | 28.5 ± 6 | 0.21 |
| TC, mg/dL | 183.9 ± 42.2 | 183.8 ± 36 | 189.6 ± 35.9 | 0.95 |
| LDL, mg/dL | 108 ± 34.3 | 107.8 ± 30.8 | 109.8 ± 28.1 | 0.92 |
| HDL, mg/dL | 45.7 ± 10.9 | 47.5 ± 12.3 | 52.2 ± 16.8 | 0.054 |
| TG, mg/dL | 122 (81 - 183) | 119 (82 - 170) | 116 (86 - 176) | 0.57 |
| HTGC, % | 5.28 (2.7 - 12.54) | 4.43 (2.36 - 9.92) | 8.65 (4.35 - 12.36) | 0.32 |

FIG. 17

| | GG | | GT | | TT | | | | |
|---|---|---|---|---|---|---|---|---|---|
| | N | Median(IQR) | N | Median(IQR) | N | Median(IQR) | P-value | Beta | CI |
| Overall | 5243 | 2.92(2.78) | 4668 | 2.84(2.71) | 1059 | 2.86(2.67) | 0.49 | -0.00892 | [-0.034, 0.016] |
| BMI<25 | 2137 | 2.18(1.5) | 1907 | 2.19(1.40) | 442 | 2.22(1.36) | 0.77 | -0.00636 | [-0.048, 0.035] |
| 25≤BMI<30 | 2294 | 3.32(2.94) | 2019 | 3.29(3.10) | 433 | 3.31(2.85) | 0.66 | 0.00975 | [-0.033, 0.052] |
| 30≤BMI<35 | 651 | 4.86(6.03) | 568 | 4.25(4.87) | 143 | 4.72(6.67) | 0.18 | -0.0534 | [-0.13, 0.025] |
| BMI≥35 | 156 | 6.37(8.8) | 165 | 5.14(8.04) | 39 | 5.60(7.47) | 0.02 | -0.175 | [-0.33, -0.022] | rs7003060

FIG. 18

186L
SCR siRNA
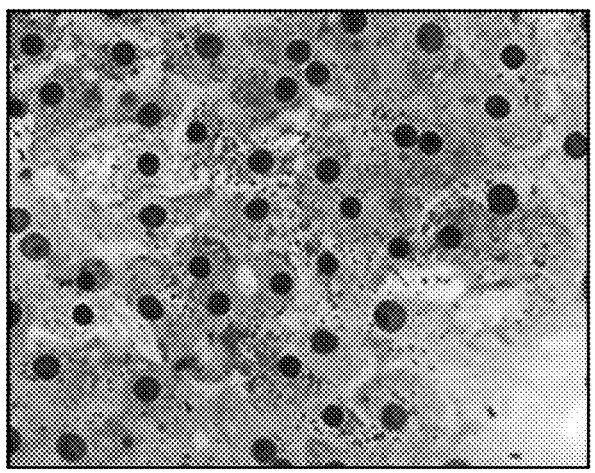
PSD3 siRNA
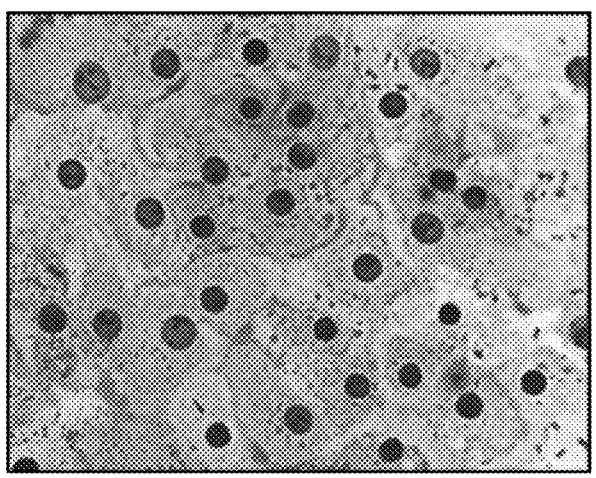
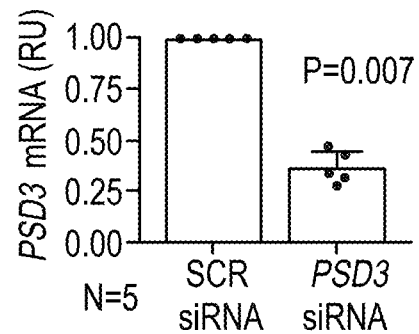
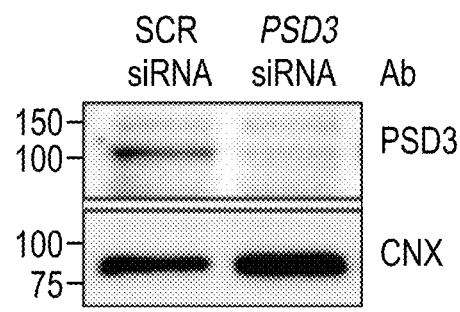
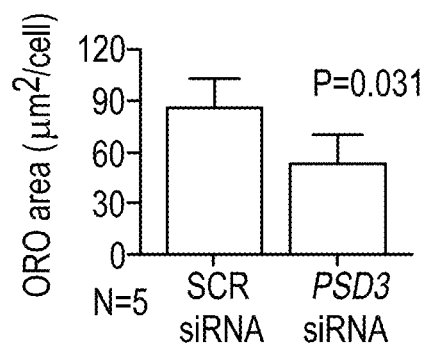
FIG. 21A 186T
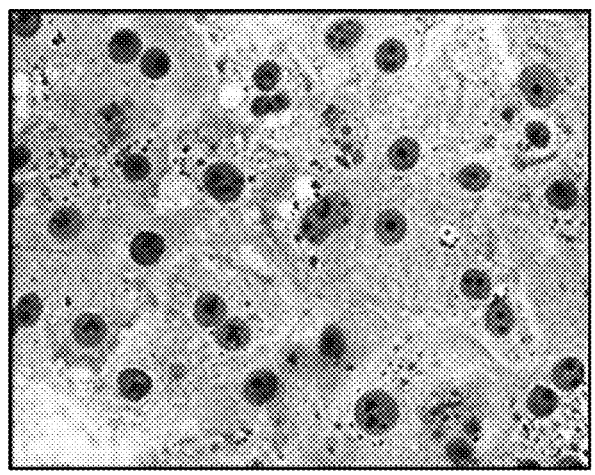
SCR siRNA
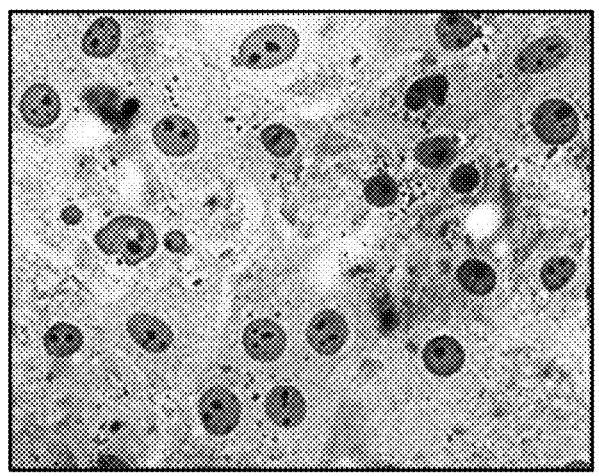
PSD3 siRNA
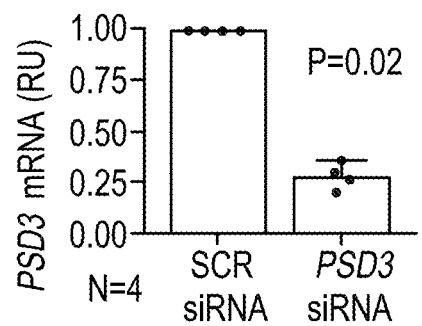
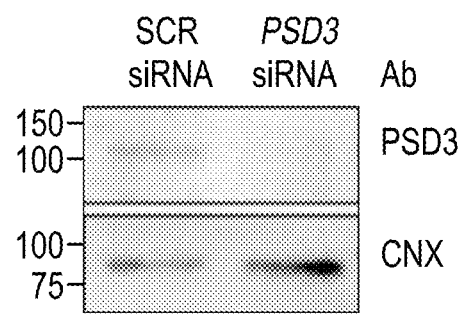
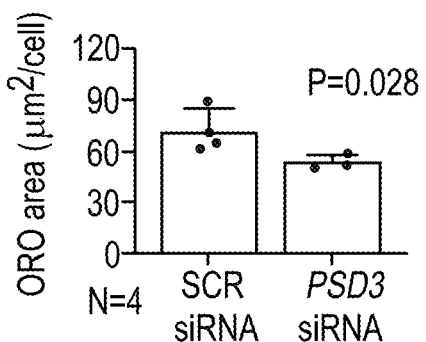
FIG. 21B

METHOD OF TREATING FATTY LIVER DISEASE

FIELD

The present disclosure provides methods of treating or preventing fatty liver disease and/or lowering cholesterol and LDL cholesterol levels in a subject. The present disclosure provides methods of lowering expression of Pleckstrin and Sec7 Domain Containing 3 (PSD3) protein in a subject. Also provided herein are compounds suitable for lowering expression of PSD3.

BACKGROUND

Fatty liver disease (FLD) is defined as hepatic lipid content exceeding 5% in the presence or absence of excessive alcohol intake. Nonalcoholic fatty liver disease (NAFLD) occurs in every age group but especially affects people in their 40 s and 50 s who are at high risk of heart disease due to high risk factors such as obesity and type 2 diabetes. Fatty liver disease is also closely linked to metabolic syndrome, which is a cluster of abnormalities including increased abdominal fat, poor ability to use the hormone insulin, high blood pressure and high blood levels of triglycerides. NAFLD is becoming increasingly common around the world; in the United States, it is the most common form of chronic liver disease and affects an estimated 80 to 100 million people (Mayo Clinic, Nonalcoholic Fatty Liver Disease). Worldwide, NAFLD affects about 25% of the global population. NAFLD includes non-alcoholic fatty liver (NAFL) and non-alcoholic steatohepatitis (NASH). Patients whose NAFL develops into NASH have increased overall and liver-specific mortality and increased risks of cirrhosis, liver failure and hepatocellular carcinoma (HCC). NASH is fast becoming the leading cause of chronic liver disease and is set to overtake hepatitis C as the leading cause of liver transplantation in the USA. Hepatic steatosis in people with NAFL is characterized by substantial accumulation of lipid droplets within hepatocytes. The progression to NASH is marked by hepatic inflammation and hepatocellular injury, with or without hepatic fibrosis, in histological examinations of liver biopsies. Progressive fibrosis drives poor liver-related clinical outcomes and develops in 35%-41% of patients with NASH, according to meta-analyses of paired biopsy studies.

Current treatment options include weight loss and, in the case of alcoholic fatty liver disease, reducing or ceasing alcohol intake. Currently, no pharmaceutical product has been approved to treat nonalcoholic fatty liver disease or alcoholic fatty liver disease. Mechanistically, liver damage including inflammation, hepatocellular injury and fibrosis involve similar pathways in nonalcoholic fatty liver disease and alcoholic fatty liver disease. It is therefore likely that a pharmaceutical product developed for nonalcoholic fatty liver disease will also work in alcoholic fatty liver disease. Furthermore, ectopic lipid accumulation including in the liver triggers pathways that will impair insulin signaling leading to hepatic insulin resistance that will lead to type 2 diabetes. Thus, therapies that reduce liver lipid levels will reverse one of the root causes of type 2 diabetes (*J. Clin. Invest.* 126(1):12-22 (2016)).

Current fatty liver disease pharmaceutical products in development may face the additional challenge of increasing the patient's cholesterol levels, which would pose increased burden on the health of the patients already at high risk of heart disease, obesity, and type 2 diabetes.

SUMMARY

The present disclosure is directed to a method of treating or preventing fatty liver disease in a subject in need thereof, comprising administering a compound comprising a polynucleotide effective for lowering the expression of Pleckstrin and Sec7 Domain Containing 3 (PSD3) in the subject.

In some embodiments, the fatty liver disease is non-alcoholic fatty liver disease (NAFLD), non-alcoholic steatohepatitis (NASH) (cirrhotic and non-cirrhotic NASH), dyslipidemia, mixed dyslipidemia, hypercholesterolemia, diabetes, liver fibrosis, hepatocellular carcinoma (HCC), alcoholic fatty liver disease (AFLD) or alcoholic steatohepatitis (ASH) (cirrhotic and non-cirrhotic ASH). In certain embodiments, the hypercholesterolemia is familial hypercholesterolemia. In some embodiments, the fatty liver disease is diabetes. In some embodiments, the fatty liver disease is Type 2 diabetes.

In some embodiments, the subject has a cardiovascular disease. In certain embodiments, the disease is dyslipidemia. In certain embodiments, the disease is mixed dyslipidemia. In certain embodiments, the disease is hypercholesterolemia. In certain embodiments, the disease is familial hypercholesterolemia.

In some embodiments, the method of administering of the compound to a subject in need thereof decreases one or more of intracellular liver fat content, liver weight, liver triglyceride content, plasma circulating alanine aminotransferase (ALT), liver collagen 1a1, and lipid content in the subject.

In some embodiments, the method reduces liver damage, steatosis, liver fibrosis, liver inflammation, liver scarring or cirrhosis, liver failure in the subject.

Certain embodiments are directed to a method of inhibiting expression or activity of PSD3 in a cell comprising contacting the cell with a compound comprising a polynucleotide effective in lowering PSD3 expression, thereby inhibiting expression or activity of PSD3 in the cell. In certain embodiments, the cell is a hepatocyte. In certain embodiments, the cell is in a subject. In certain embodiments, the subject has, or is at risk of non-alcoholic fatty liver disease (NAFLD), non-alcoholic steatohepatitis (NASH) (cirrhotic and non-cirrhotic), dyslipidemia, mixed dyslipidemia, hypercholesterolemia, diabetes, liver fibrosis, hepatocellular carcinoma (HCC), alcoholic fatty liver disease (AFLD) or alcoholic steatohepatitis (ASH) (cirrhotic and non-cirrhotic ASH), or Type 2 diabetes.

In some embodiments, the disclosure provides a method of reducing activation of ADP-ribosylation factor 6 (ARF6), the method comprising lowering of PSD3 expression in a subject, comprising administering a compound comprising a polynucleotide effective for lowering the expression of Pleckstrin and Sec7 Domain Containing 3 (PSD3) in the subject, wherein lower PSD3 expression provides for reduced activation of ARF6.

In some embodiments, the disclosure provides a method of lowering intracellular fat content in a liver cell in a subject, the method comprising administering a compound comprising a polynucleotide effective for lowering the expression of Pleckstrin and Sec7 Domain Containing 3 (PSD3) in the subject.

In some embodiments, the disclosure provides a method of lowering cholesterol in a subject, the method comprising administering a compound comprising a polynucleotide effective for lowering the expression of Pleckstrin and Sec7

Domain Containing 3 (PSD3) in the subject. In some embodiments, the LDL cholesterol is lowered in the subject.

In some embodiments, the disclosure provides a method of identifying a subpopulation of subjects having fatty liver disease suitable for PSD3 reduction therapy, the method comprising; (i) diagnosing whether the subject has fatty liver disease; (ii) determining whether the subject has the 186T allelic variant of PSD3 or the 186L allelic variant of PSD3; wherein if the subject has the 186L allelic variant of PSD3, then a suitable treatment comprises administering a compound comprising a polynucleotide effective for lowering the expression of PSD3; and wherein if the subject has the 186T allelic variant of PSD3, then treatment does not comprise administering a compound comprising a polynucleotide effective for lowering the expression of PSD3 is not suitable. In some embodiments, step (ii) may be determined by genotyping the 186L allelic variant or by inference from genotyping a genetic variant in strong linkage disequilibrium with the 186L allelic variant.

In some embodiments, the disclosure provides a method of treating a subject having fatty liver disease, the method comprising; (i) determining whether the subject has the 186T allelic variant of PSD3 or the 186L allelic variant of PSD3; and (ii) administering a compound comprising a polynucleotide effective for lowering the expression of PSD3 only if the subject has the 186L allelic variant of PSD3. In some embodiments, step (i) may be determined by genotyping the 186L allelic variant or by inference from genotyping a genetic variant in strong linkage disequilibrium with the 186L allelic variant. In some embodiments, the subject does not have a 186T allelic variant of PSD3. In any of the preceding embodiments, the subject is human.

In some embodiments, the compound is selected from an antisense oligonucleotide (ASO), an siRNA, or an ssRNAi. In some embodiments, the compound comprises a polynucleotide that is a complementary to an equal length portion of any one of SEQ ID NOs: 2-18. In some embodiments, the polynucleotide is single-stranded. In some embodiments, the polynucleotide is paired with a second polynucleotide to form a duplex. In certain embodiments, the compound is an siRNA compound.

In some embodiments, the polynucleotide consists of 8 to 50 linked nucleosides and has a nucleobase sequence at least 90% complementary to an equal length portion of a nucleic acid encoding PSD3. In some embodiments, the polynucleotide consists of 12 to 30 linked nucleosides in length.

In some embodiments, the polynucleotide has a nucleobase sequence at least 90% complementary to an equal length portion of all or any one of SEQ ID NOs: 2-18.

In some embodiments, the polynucleotide comprises at least one modification selected from at least one modified internucleoside linkage, at least one modified sugar moiety, and at least one modified nucleobase.

In certain embodiments, at least one of the nucleosides of the polynucleotide comprise a modified sugar moiety. In certain embodiments, the modified sugar is a bicyclic sugar or 2'-O-methyoxyethyl. In certain embodiments, the modified sugar comprises a 4'-CH(CH$_3$)—O-2' bridge or a 4'-(CH$_2$)$_n$—O-2' bridge, wherein n is 1 or 2.

In certain embodiments, at least one of the nucleosides of the polynucleotide comprise a modified nucleobase. In certain embodiments, the modified nucleobase is a 5-methylcytosine.

In certain embodiments, at least one internucleoside linkage of the polynucleotide is a modified internucleoside linkage. In some embodiments, the modified internucleoside linkage is a phosphorothioate internucleoside linkage.

In some embodiments, the polynucleotide is an antisense oligonucleotide. In certain embodiments, the antisense oligonucleotide has:
a gap segment consisting of linked deoxynucleosides;
a 5' wing segment consisting of linked nucleosides;
a 3' wing segment consisting linked nucleosides;
wherein the gap segment is positioned immediately adjacent to and between the 5' wing segment and the 3' wing segment and wherein each nucleoside of each wing segment comprises a modified sugar.

In some embodiments, the compound comprises a conjugate group. In certain embodiments, the conjugate group is attached at the 5'-end or the 3'-end of the polynucleotide. In certain embodiments, the conjugate group comprises one to five GalNAc moieties. In some embodiments, the compound is delivered to a liver cell of the subject.

In certain embodiments, the compound is administered parenterally. In some embodiments, the parenteral administration is subcutaneous or intravenous administration. In some embodiments, the method comprises co-administering the compound and at least one additional therapy.

In some embodiments, the disclosure provides a compound comprising polynucleotide consisting of 8 to 50 linked nucleosides and having a nucleobase sequence at least 90% sequence complementary to an equal length portion of SEQ ID Nos: 2-18.

In some embodiments, the polynucleotide consists of 10 to 30 linked nucleosides. In some embodiments, the polynucleotide consists of 12 to 20 linked nucleosides. In some embodiments, the polynucleotide consists of 16 linked nucleosides.

In some embodiments, at least one of the nucleosides of the polynucleotide comprise a modified sugar moiety. In some embodiments, the modified sugar is a bicyclic sugar or 2'-O-methyoxyethyl. In certain embodiments, the modified sugar comprises a 4'-CH(CH$_3$)—O-2' bridge or a 4'-(CH$_2$)$_n$—O-2' bridge, wherein n is 1 or 2.

In certain embodiments, at least one of the nucleosides of the polynucleotide comprise a modified nucleobase. In some embodiment, the modified nucleobase is a 5-methylcytosine.

In some embodiments, at least one of the internucleoside linkages of the polynucleotide is a modified internucleoside linkage. In some embodiments, at least one modified internucleoside linkage is a phosphorothioate internucleoside linkage.

In some embodiments, the polynucleotide is an antisense oligonucleotide. In certain embodiments, the antisense oligonucleotide has:
a gap segment consisting of linked deoxynucleosides;
a 5' wing segment consisting of linked nucleosides;
a 3' wing segment consisting linked nucleosides;
wherein the gap segment is positioned immediately adjacent to and between the 5' wing segment and the 3' wing segment and wherein each nucleoside of each wing segment comprises a modified sugar.

In certain embodiments, the compound comprises one to five GalNAc moieties. In certain embodiments, the GalNAc moieties are attached at the 5'-end or the 3'-end of the polynucleotide.

In some embodiments, the disclosure is directed to an antisense oligonucleotide, wherein the nucleobase sequence of the antisense oligonucleotide is the sequence of SEQ ID NO: 1.

BRIEF DESCRIPTION OF THE DRAWINGS

FIG. 1 shows a table of 32 loci affecting triglycerides in individuals of European descent (Teslovich et al., Nature 466, 707-713, 2010), as described in Example 1. Abbreviations: TG, triglycerides; TC, total cholesterol; LDL, low-density lipoproteins; HDL, high-density lipoproteins.

FIG. 2 shows a table of missense variants associated with hepatic triglyceride content in the Dallas Heart Study, as described in Example 1. Out of 32 loci identified by a previous genome wide study on circulating triglyceride levels, a total of 3 missense variants with a MAF in Europeans >5% were nominally associated with hepatic triglyceride content in the DHS cohort. Of these variants, one was associated with decrease in hepatic fat content (rs71519934, beta=−0.02), and 2 were associated with increased hepatic fat content (rs1260326, beta=0.03 and rs58542926, beta=0.12). The association was tested by linear regression analysis adjusted for age, gender, and top four principal components of ancestry. Abbreviations: Chr, chromosome; rsID, reference single nucleotide polymorphism identification; N0, number of individuals homozygote for the major allele; N1, number of individuals heterozygote; N2, number of individuals homozygote for the minor allele; MAF, minor allele frequency. ^MAF refers to the minor allele frequency in the overall DHS cohort. In the DHS, the rs71519934 was found as rs7003060 that is in complete linkage disequilibrium (D'=1, r2=1) with the rs71519934. ^^MAF EUR refers to 1000Genome data reported in the Database of Single Nucleotide Polymorphisms (dbSNP, Current Build 154 Released Apr. 21, 2020), except for the rs71519934 where the frequency was estimated in White British participants from the UK Biobank 50,000 exome sequencing data because not available in dbSNP. *Genotyping of GCKR was undetermined in two individuals.

FIG. 3 shows continuous and categorical traits of the Liver Biopsy Cohort (LBC) and Independent Replication EU Cohort ("Central European Cohort"). Continuous traits are shown as mean and standard deviation (normally distributed traits) or median and quartile range (non-normally distributed traits). Categorical traits are shown as numbers and proportions. *data available for n=1,805.

FIG. 4 shows a table of PSD3 rs71519934 minor allele association with lower prevalence of liver disease in the Liver Biopsy Cohort (LBC, Nhistological data=1,951) as measured by lower prevalence of liver steatosis, fibrosis, inflammation, and ballooning by using binary logistic regression analysis under an additive genetic model adjusted by age, gender, BMI, centre of recruitment and number of PNPLA3 mutant allele. Presence of steatosis, fibrosis, inflammation or ballooning was defined as the relative degree >0. *data available for n=1,805.

FIG. 5A illustrates histological liver damage stratified by PSD3 genotype in the liver biopsy cohort (LBC). The bars show the degree of the specified disease and the colour shading from white to black indicates increased disease severity. Histological damage was evaluated according to the different components of the FLD activity score (NAS) and hepatic fibrosis stage. Carriers of the PSD3 rs71519934 186T minor allele had less severe liver disease with lower degrees of steatosis, inflammation, ballooning and fibrosis. The association was tested by an ordinal regression analysis adjusted for age, gender, BMI, recruitment centre and number of PNPLA3 I148M mutant allele.

FIG. 5B shows the total PSD3 mRNA expression stratified by healthy and FLD livers. Liver PSD3 expression levels were higher in FLD subjects compared to healthy controls. P values were calculated by Mann-Whitney non-parametric test. FIG. 5C shows the total NAT2 mRNA expression stratified by healthy and FLD livers. There was no difference in the NAT2 expression level based on the presence of FLD. P values were calculated by Mann-Whitney non-parametric test. Abbreviations: Ctr, healthy control livers (n=10); FLD, livers with fatty liver disease (n=67); PSD3, pleckstrin and Sec7 domain containing 3; NAT2, N-acetyltransferase 2.

FIG. 6 shows that PSD3 rs71519934 minor allele associates with lower prevalence and lower severity of liver disease in the Independent Replication EU Cohort (N histological data=674). The association was tested by binary logistic (disease presence) or ordinal regression (disease severity) analysis under an additive genetic model adjusted by age, gender, BMI, centre of recruitment and number of PNPLA3 mutant allele. Odds Ratio (OR) for ordinal regression was calculated as exponentials of the coefficient estimate and its confidence interval (CI). Presence of steatosis, fibrosis, inflammation or ballooning has been defined as the relative degree >0.

FIG. 7 shows continuous and categorical traits of the Liver Biopsy Cohort (LBC) and the replication cohort from the Independent Replication EU Cohort ("Central European Cohort") as stratified by PSD3 rs71519934. Continuous traits are shown as mean and standard deviation (normally distributed traits) or median and quartile range (non-normally distributed traits). Categorical traits are shown as numbers and proportions. For continuous traits, P-values were calculated by linear regression under an additive genetic model unadjusted (age) or adjusted for age, gender and recruitment centre (BMI), or by age, gender, BMI and recruitment centre. Non-normally distributed traits were log-transformed before entering the model. For categorical traits, P-values were calculated by chi-square test (gender) or by binary logistic regression adjusted for age, gender, BMI and recruitment centre (diabetes).

FIGS. 8A-B show tables summarizing the meta-analyses of the association between the PSD3 rs71519934 and liver histological traits in the Liver Biopsy Cohort (LBC) and the Independent Replication EU Cohort. An inverse variance meta-analysis of two studies was performed using package "meta" with fixed- and random-effect models in R version 3.6.1. FIG. 8A shows results for steatosis severity, fibrosis severity, inflammation severity, and ballooning severity. FIG. 8B shows results for steatosis presence, fibrosis presence, inflammation presence, and ballooning presence.

FIG. 9A shows the expression level of the different PSD3 mRNA isoforms in human liver tissue. The transcriptome from liver biopsies of a subset of 77 individuals from Milan subgroup of the Liver Biopsy Cohort (LBC). Isoform 001 (identified as ENST00000327040 by Ensembl or as NP_056125 [isoform-a] by NCBI, 1047 aa) was expressed with the highest level followed by isoform 008 (identified as ENST00000521841 by Ensembl, noncoding). FIG. 9B shows total PSD3 mRNA expression stratified by rs71519934 genotype. No differences were found in the PSD3 mRNA expression levels when stratified by genotype. P value calculated by linear regression unadjusted. Values were log-transformed before entering the model. FIG. 9C shows total NAT2 mRNA expression levels did not differ among PSD3 rs71519934 genotypes. P value calculated by linear regression unadjusted. Values were log-transformed before entering the model. Abbreviations: FPKM, fragments per kilobase of exon model per million reads mapped; 186L:

homozygotes for the L allele (n=42); L186T: heterozygotes (n=29); 186T: homozygotes for the T allele (n=6).

FIGS. 10A-D shows that downregulation of PSD3 in vitro by using siRNA in McA-RH7777 cells, as compared to cells transfected with scramble (Scr) siRNA, resulted in lower intracellular neutral fat content (FIG. 10A), de novo triglyceride synthesis (FIG. 10B) and Apolipoprotein b (Apo-b) secretion (FIG. 10C) with no differences in beta oxidation (FIG. 10D), as described in Example 2. Intracellular neutral fat content was visualized by ORO staining (top panels), and quantified by Biopix; de novo triglyceride synthesis was measured as radiolabelled newly synthesized triglycerides separated by TLC and quantified by scintillation counting 15, 30, 60 minutes after incubation with 5 µCi/ml $^3$H-glycerol plus 50 µM oleic acid; Apo-b secretion was visualized by SDS-PAGE and its quantification. Cells were pulsed with 0.05 mCi/mL $^{35}$S Met/Cys+50 µM OA for 2 hours. Chase media with excess L-methionine and L-cysteine was incubated for 5, 15, 30 or 60 mins. Apo-b was immunoprecipitated from media and visualized by phosphorimager after separation on SDS-PAGE. Beta oxidation was measured as precipitated radiolabeled palmitate. Cells were incubated with 8.5 µCi/mL 3H-palmitate+55 µmol/L palmitic acid for 2 hours after which palmitate was precipitated with BSA and perchloric acid and quantified by scintillation counting. Data shown as mean±SD of the reported independent experiments. For each figure panel, the average of PSD3 downregulation efficiency was ~80% as evaluated by real-time quantitative PCR analysed by the $2^{-\Delta\Delta Ct}$ method. P-values calculated by Mann Whitney non parametric test comparing Scr siRNA vs. PSD3 siRNA. Abbr: AU: arbitrary units; RU: relative units; dpm: disintegrations per minute.

Figure 11:
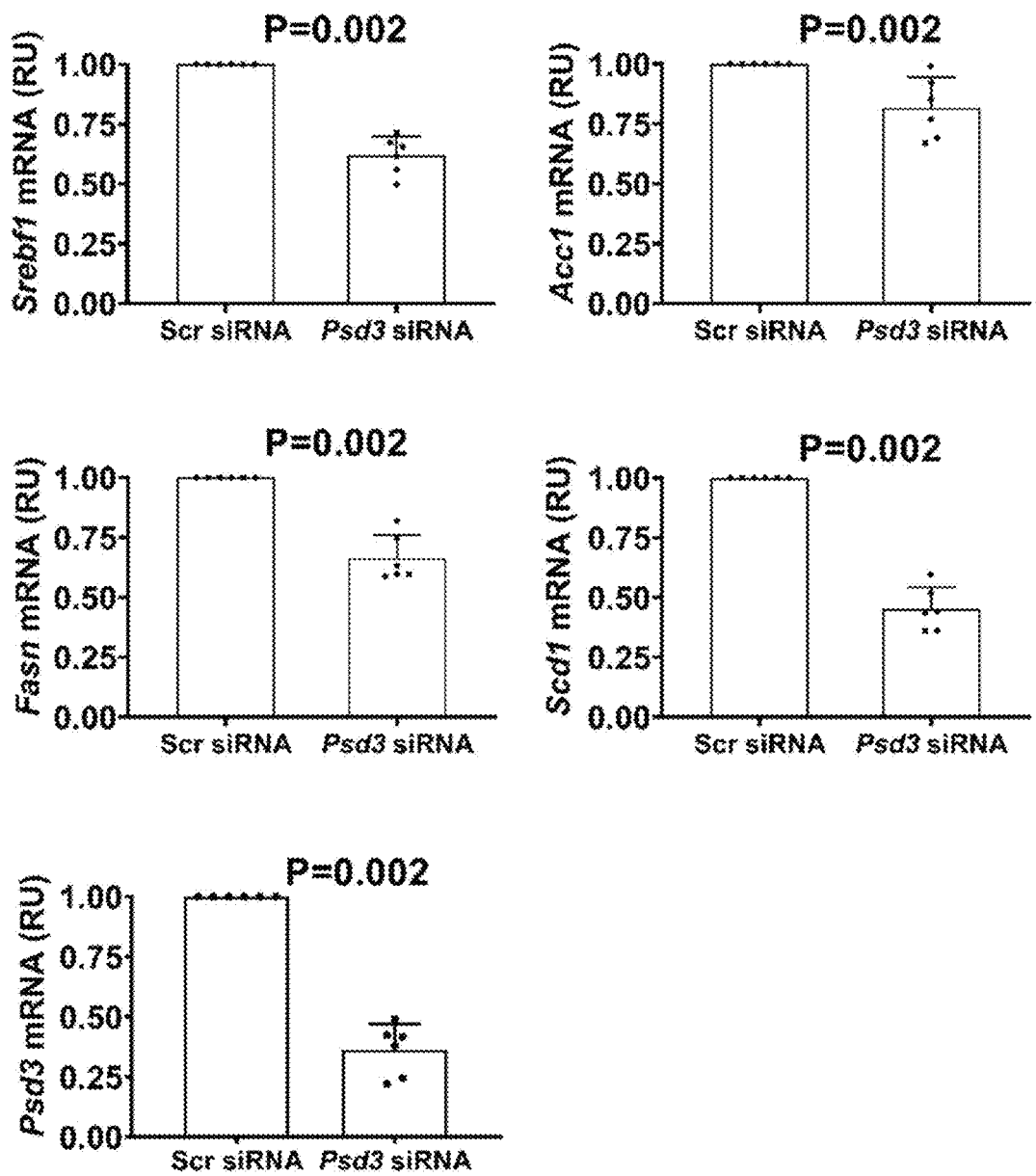

FIG. 11 shows that downregulation of PSD3 by using siRNA in rat McA-RH7777 hepatocytes resulted in reduced expression of genes involved in lipogenesis. The data is shown as the mean and SD of 6 independent experiments. P values were calculated by Mann Whitney non parametric test comparing Scr siRNA vs. PSD3 siRNA.

Figure 12A:
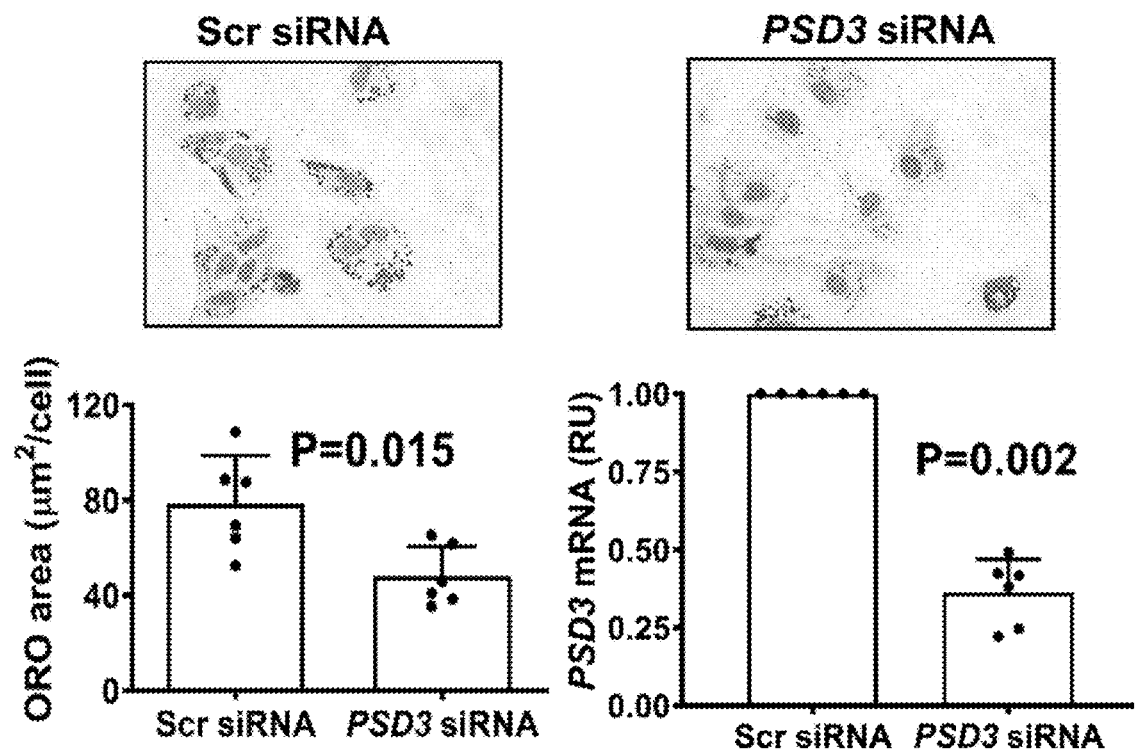
Figure 12B:
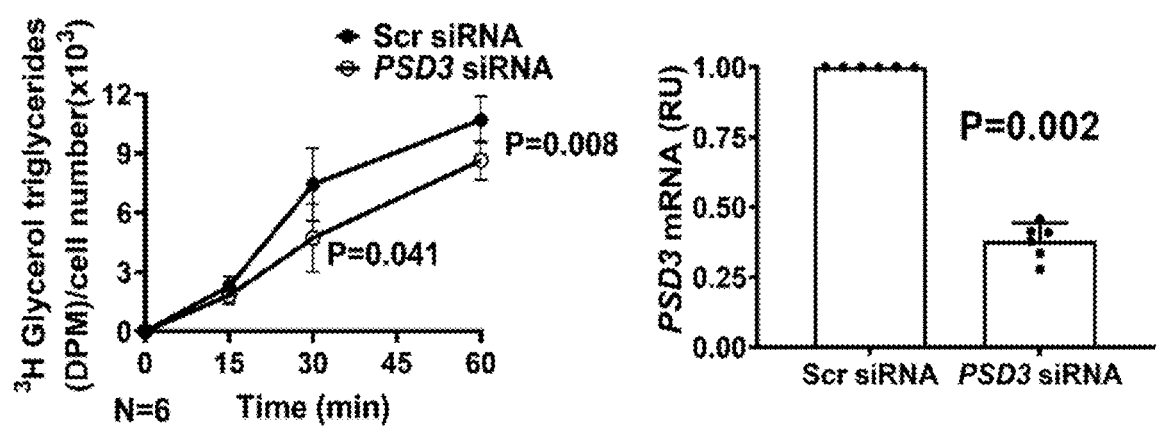

FIGS. 12A-B shows the effects of downregulation of PSD3 by using siRNA in human immortalized Huh7 hepatocytes. FIG. 12A shows the effect on intracellular neutral fat content compared to cells transfected with scramble siRNA. Intracellular fat content was visualized by ORO staining (top panels), and the area of ORO was quantified by Biopix. The efficiency of PSD3 mRNA downregulation was ~65%, as evaluated by real-time quantitative PCR analysed by the 2-ΔΔCt method. Cells were seeded in triplicate and, 24 h after seeding, they were transfected with scramble or PSD3-siRNA and grown in regular medium without FBS plus 25 µM OA for 48 h. FIG. 12B shows the effect on de novo de novo triglyceride synthesis as measured by newly synthesized triglycerides separated by TLC and quantified by scintillation counting 15, 30, 60 minutes after incubation with 5 µCi/ml 3H-glycerol plus 50 µM oleic acid. The data are shown as the mean and SD of the reported independent experiments. P-values calculated by Mann Whitney non-parametric test comparing Scr siRNA vs. PSD3 siRNA.

Figure 13A:
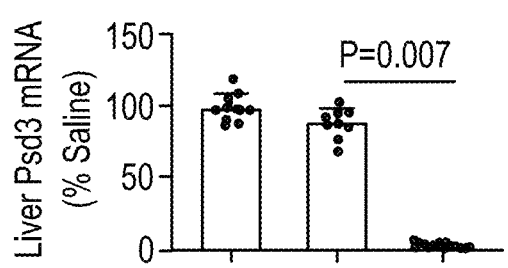
Figure 13B:
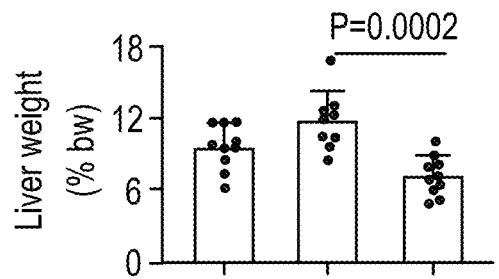
Figure 13C:
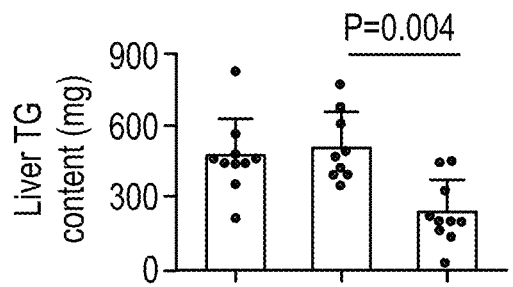
Figure 13D:
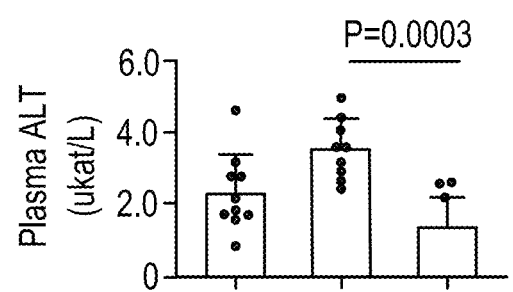
Figure 13E:
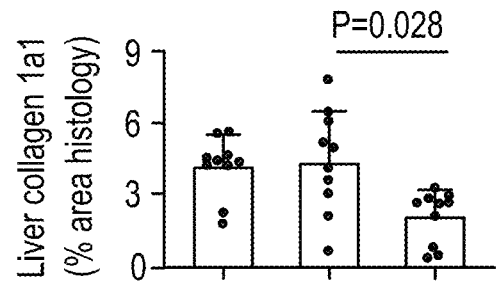
Figure 13F:
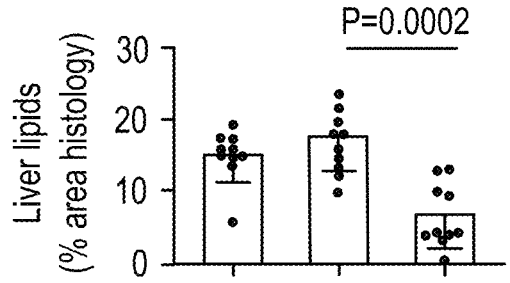
Figure 13G:
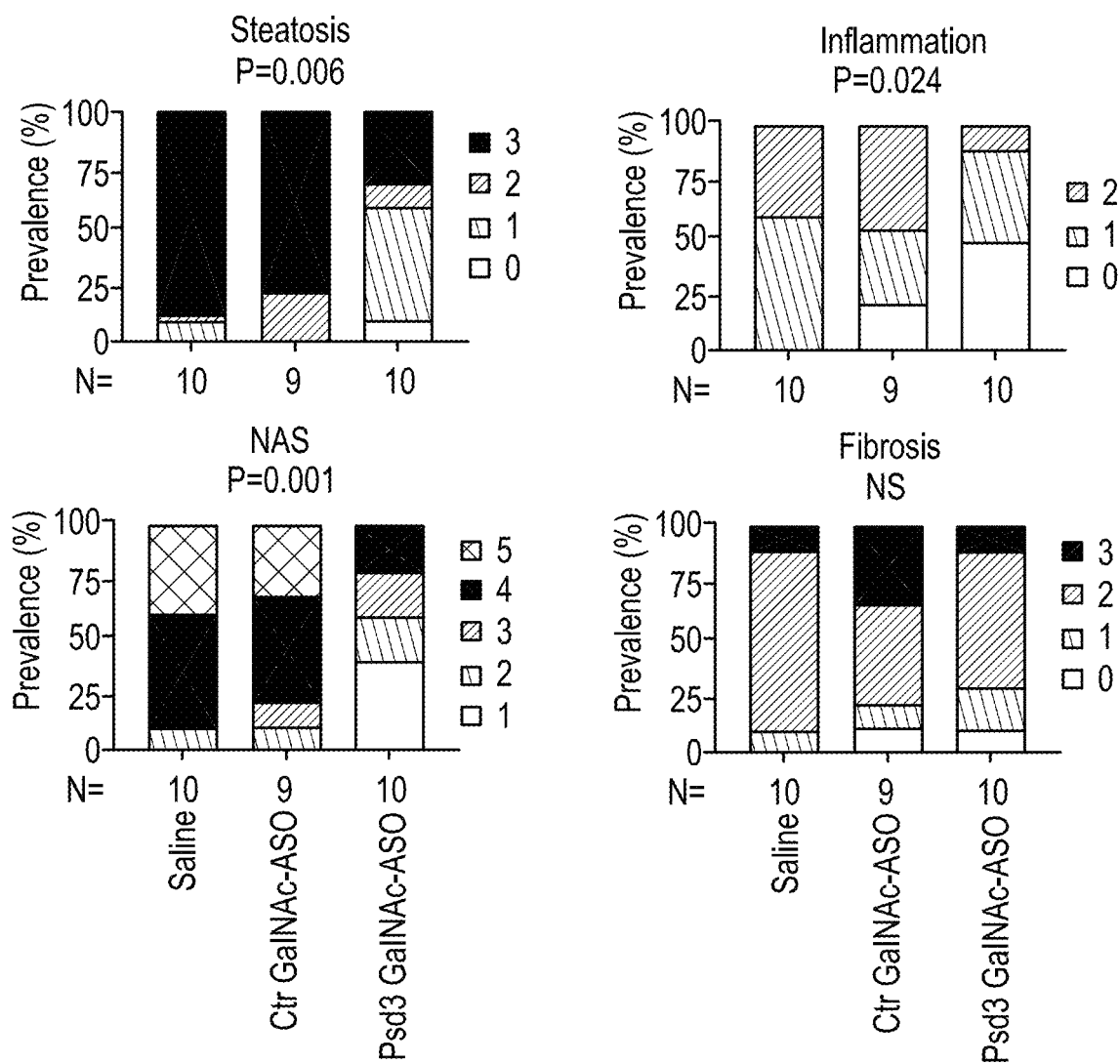

FIGS. 13A-G shows the effects of downregulation of liver PSD3 in C57BL/6 male mice fed a NASH-inducing diet for a total of 50 weeks on severity of steatosis, inflammation, and NAFLD activity score (NAS), as described in Example 3. During the last 16 weeks, groups of mice were dosed via once weekly subcutaneous injections with saline, control GalNac-ASO (5 mg/kg/wk), or PSD3 GalNAc-ASO (5 mg/kg/wk). PSD3 GalNAc-ASO reduced liver PSD3 mRNA expression levels (FIG. 13A) and was associated with reduced liver weight, (FIG. 13B), total liver triglyceride content, (FIG. 13C) plasma ALT levels, (FIG. 13D) liver collagen 1a1 protein levels, (FIG. 13E) and liver lipid droplet number (FIG. 13F). PSD3 GalNAc-ASO treatment also reduced the severity of steatosis and inflammation and the NAFLD activity score, while there were no significant changes in the liver fibrosis score (FIG. 13G). The data are shown as the mean and SD. P values were calculated by one-way ANOVA Kruskal-Wallis non-parametric test followed by Dunn's correction for multiple comparisons. Multiple comparisons were performed comparing the mean of each group with the mean of the control group (Ctr GalNAc-ASO). The severity scores of liver disease were analyzed with ordinal regression analyses.

Figure 14A:
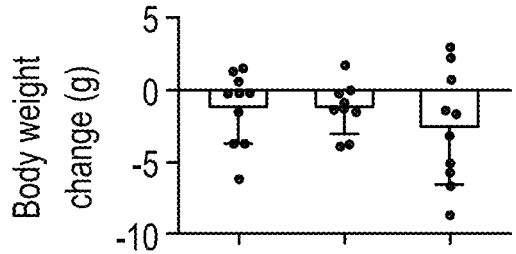
Figure 14B:
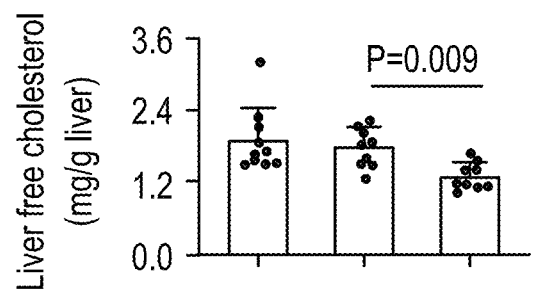
Figure 14C:
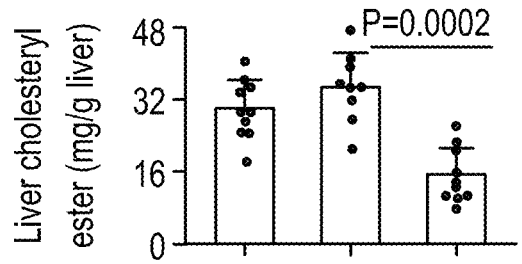
Figure 14D:
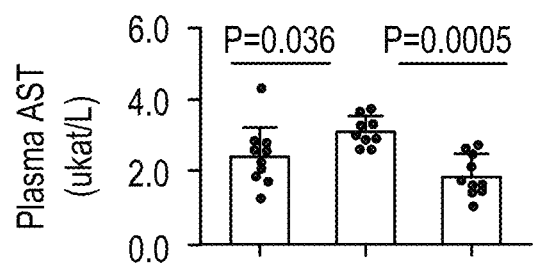
Figure 14E:
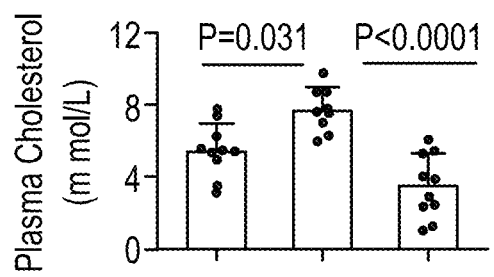
Figure 14F:
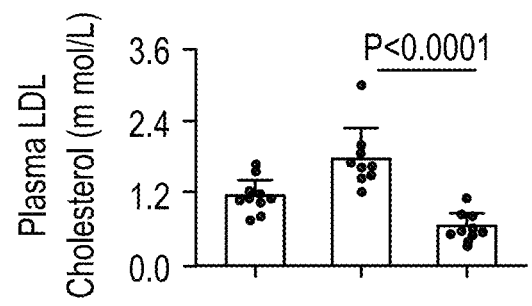
Figure 14G:
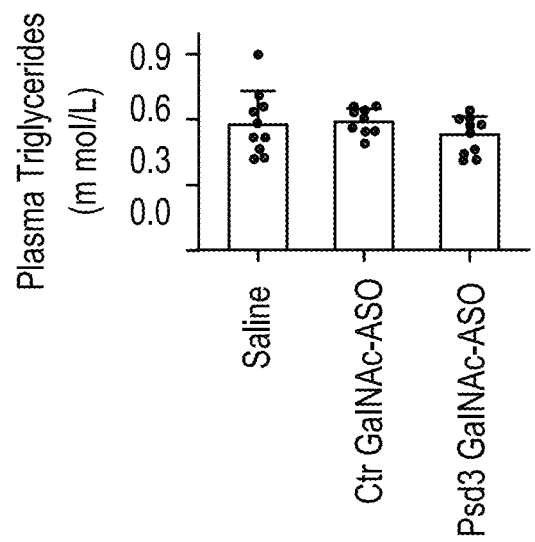
Figure 14H:
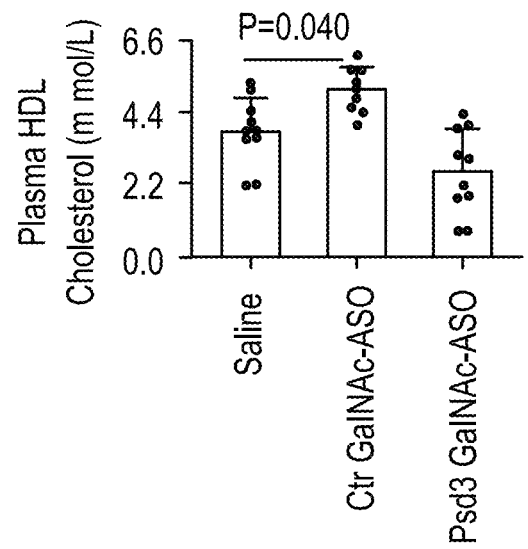

FIGS. 14A-H shows the effects of downregulation of liver PSD3 in C57BL/6 male mice fed a NASH-inducing diet for a total of 50 weeks, as described in Example 3. During the last 16 weeks, groups of mice were dosed via once weekly subcutaneous injections with saline, control GalNac-ASO (5 mg/kg/wk), or PSD3 GalNAc-ASO (5 mg/kg/wk). PSD3 GalNAc-ASO did not significantly affect body weight gain (FIG. 14A) but reduced liver cholesterol (FIG. 14B) and cholesteryl ester levels (FIG. 14C) and plasma AST (FIG. 14D), cholesterol (FIG. 14E) and LDL cholesterol levels (FIG. 14F). There were no significant effects on plasma triglyceride (FIG. 14G) or HDL cholesterol levels (FIG. 14H). The data are shown as the mean±SD. P values were calculated by Kruskal-Wallis non-parametric tests followed by Dunn's multiple comparisons tests. Multiple comparisons were performed by comparing each group with the control group (Ctr GalNAc-ASO).

Figure 15:
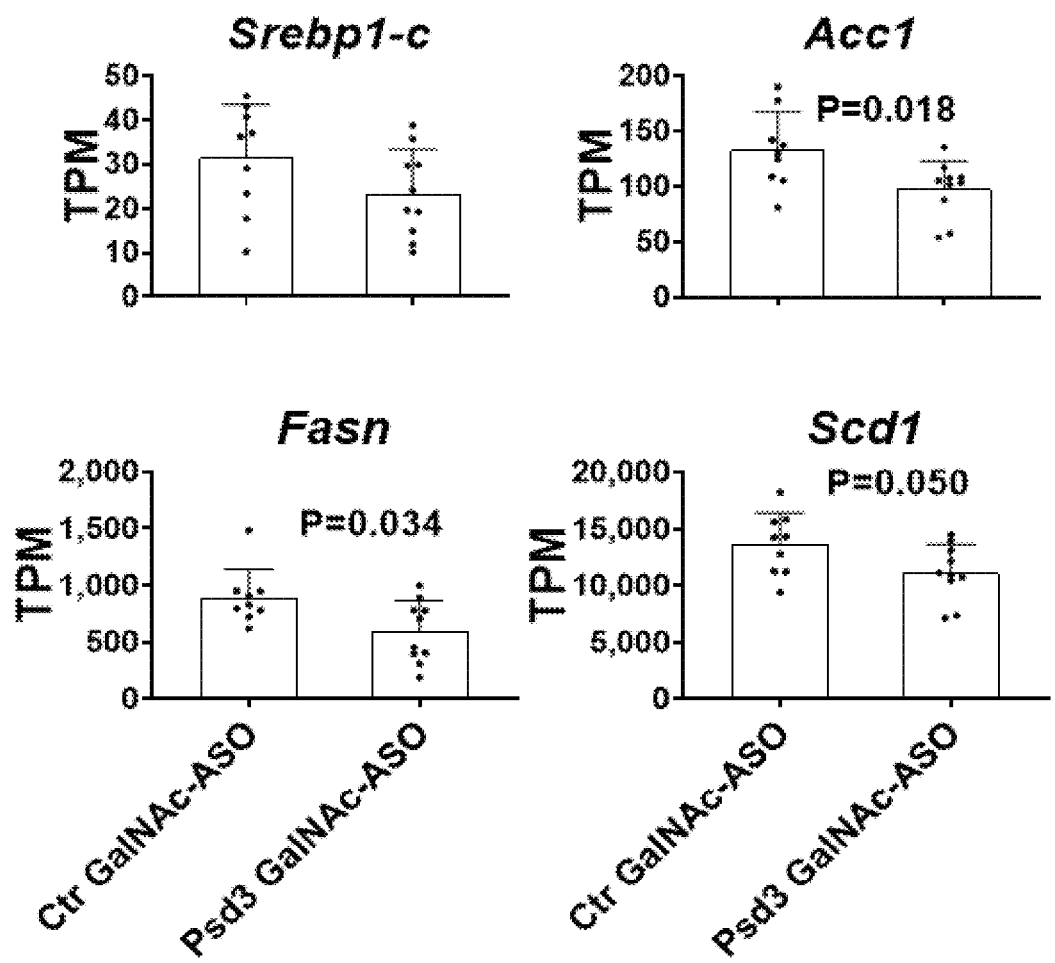

FIG. 15 shows the effects of downregulation of liver PSD3 in C57BL/6 male mice fed a NASH-inducing diet for a total of 50 weeks, as described in Example 3. During the last 16 weeks, groups of mice were dosed via once weekly subcutaneous injections with saline, control GalNac-ASO (5 mg/kg/wk), or PSD3 GalNAc-ASO (5 mg/kg/wk). Hepatic mRNA was quantitated by digital gene expression profiling and is expressed as transcripts per million (TPM). PSD3 GalNAc ASO treatment significantly reduced hepatic Acc1, Fasn, and Scd1 mRNA expression. The data are shown as the mean and SD. P values were calculated by one-way ANOVA Kruskal-Wallis non-parametric test.

FIG. 16 shows that PSD3 minor allele associates with lower prevalence of liver disease in the Liver Biopsy cohort (LBC) after adjustment for genetic risk factors. The association was tested by an ordinal regression analysis adjusted for age, gender, BMI, recruitment centre, number of PNPLA3 I148M mutant allele (n=1,950) and further adjusted for other main genetic risk factors (TM6SF2 rs58542926 [E167K] (n=1,943), MBOAT7 rs641738 (n=1, 938), and GCKR rs1260326 [L446P] (n=1,863) and presence of diabetes)*data available for n=1,805

FIG. 17 shows a table of participants in the Dallas Heart Study, as described in Example 1, stratified by PSD3 L186T genotype. P-values were calculated by linear regression adjusted for age, gender, and BMI as necessary, and adjusted or stratified for self-reported ethnicity.

FIG. 18 shows the association of proton density fat fraction (PDFF) with PSD3 rs7003060 overall and within four BMS strata in white British participants from the UK Biobank. Analysis was performed using a linear regression adjusted for age, sex, BMI, the first 10 principal components of ancestry and array type.

Figure 19A:
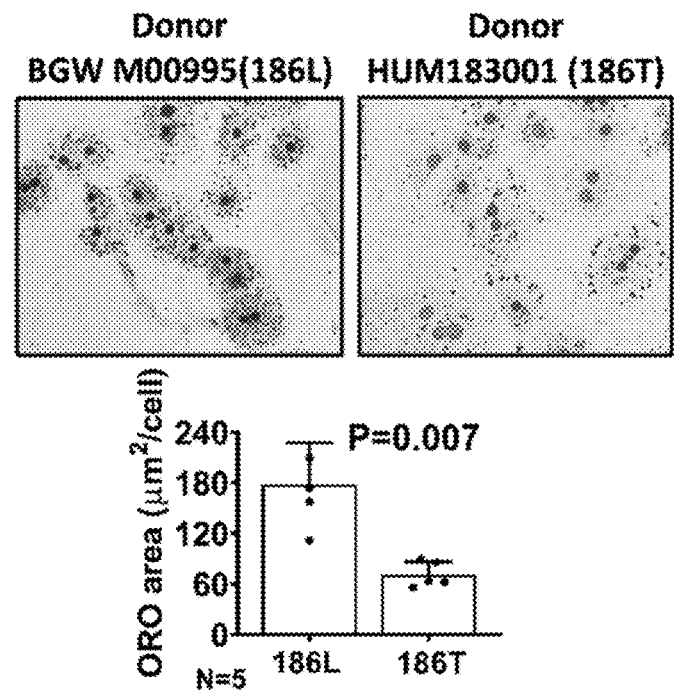
Figure 19B:
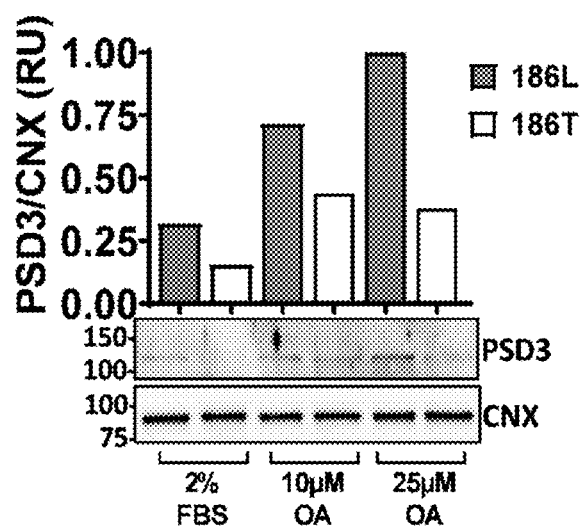
Figure 19C:
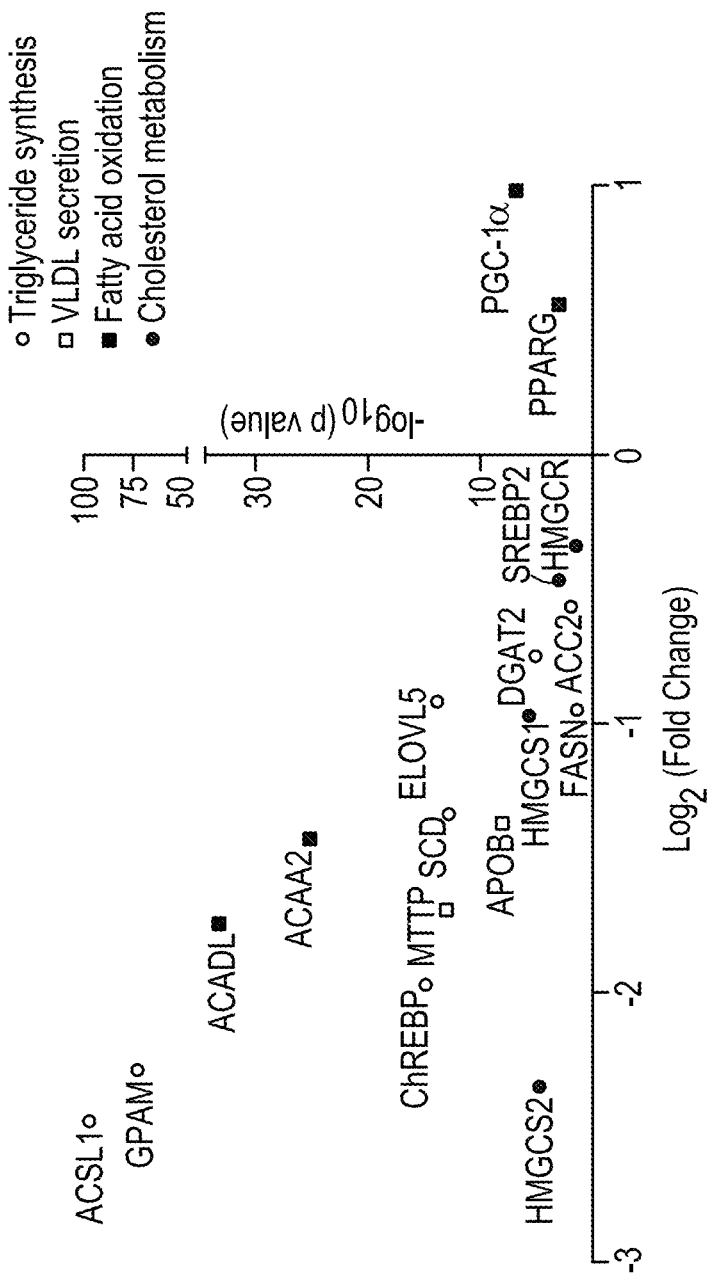

FIGS. 19A-C shows the effects on PSD3 protein and intracellular lipid levels comparing primary human hepatocytes from a donor homozygous for the 186T allele with a donor homozygous for the 186L allele in 2D. FIG. 19A shows the intracellular neutral fat content visualized by Oil Red O (ORO) staining and quantified by Biopix. Data presented as Mean and standard deviation of the reported independent experiments. P-values were calculated by Mann Whitney non-parametric test. FIG. 19B shows images of cells cultured in serum free regular medium supplemented with 2% FBS, 10 μM OA or 25 μM OA for 48 hours. Immunoblotting was performed with total cell lysates to detect PSD3 (NCBI: NP_056125, 1047 aa) using a custom antibody. The bar graph shows the relative PSD3 calculated as PSD3/Calnexin. FIG. 19C shows that key genes involved in lipid metabolism that were differentially expressed obtained with RNA-Seq. Data are presented as Log 2 fold change in expression and –log 10 of p-values. Abbr: RU: relative units, CNX: calnexin.

Figure 20A:
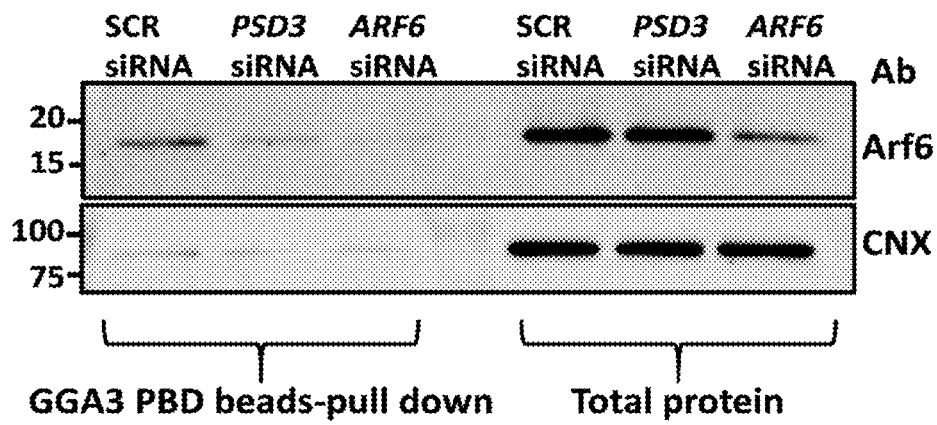
Figure 20B:
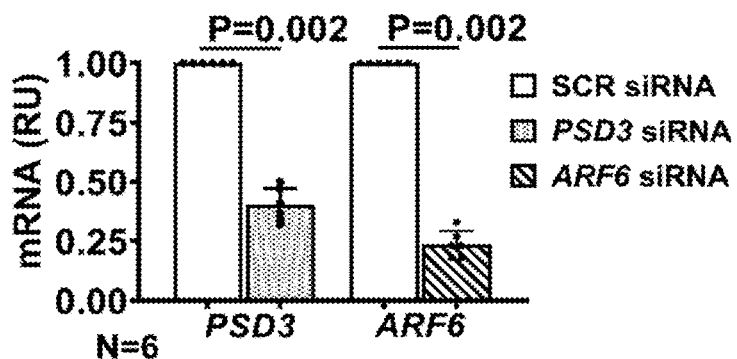
Figure 20C:
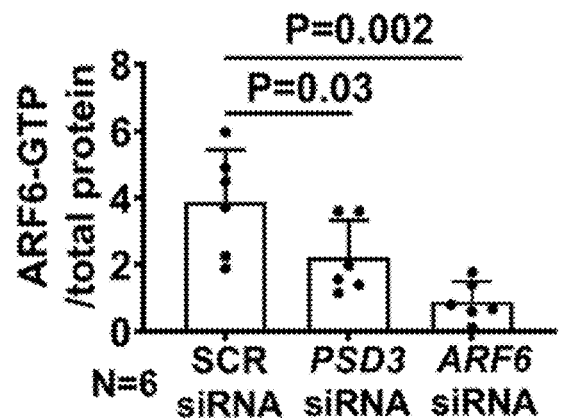
Figure 21C:
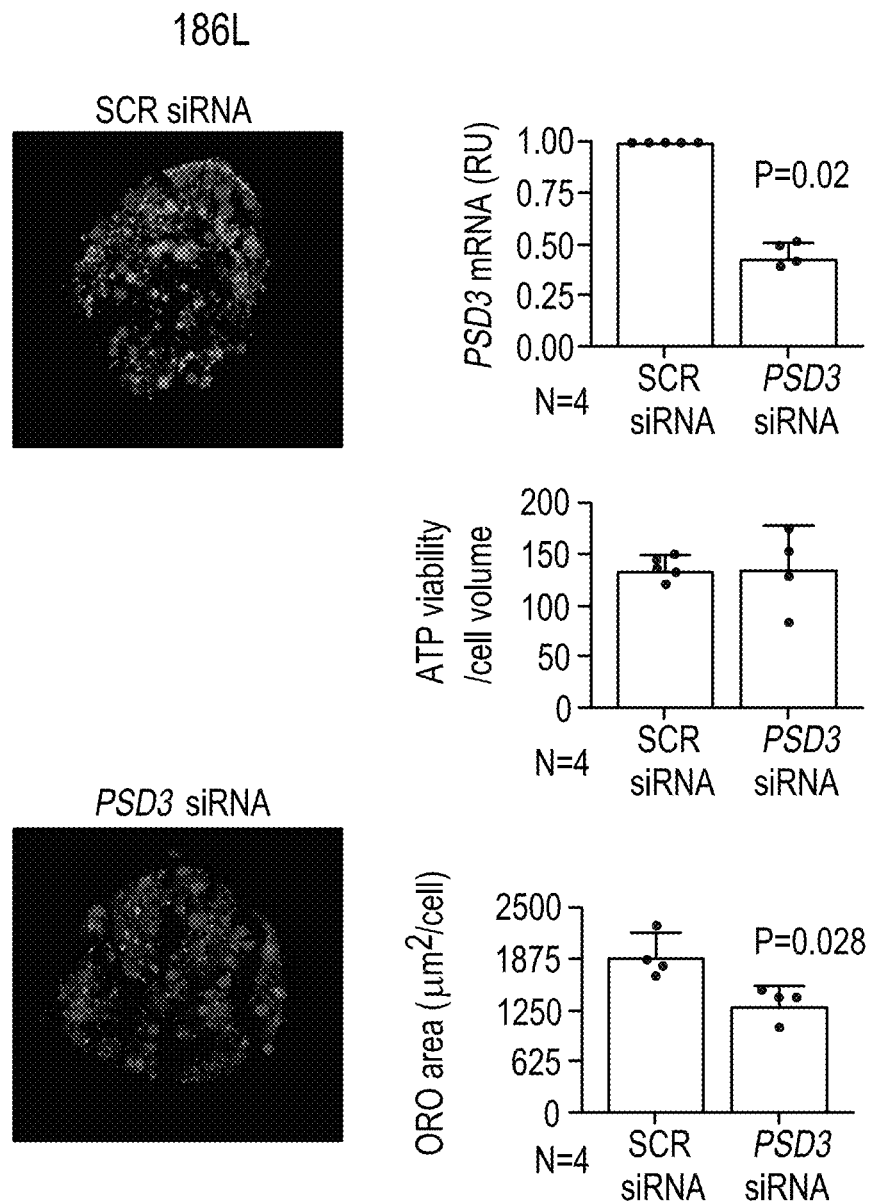
Figure 21D:
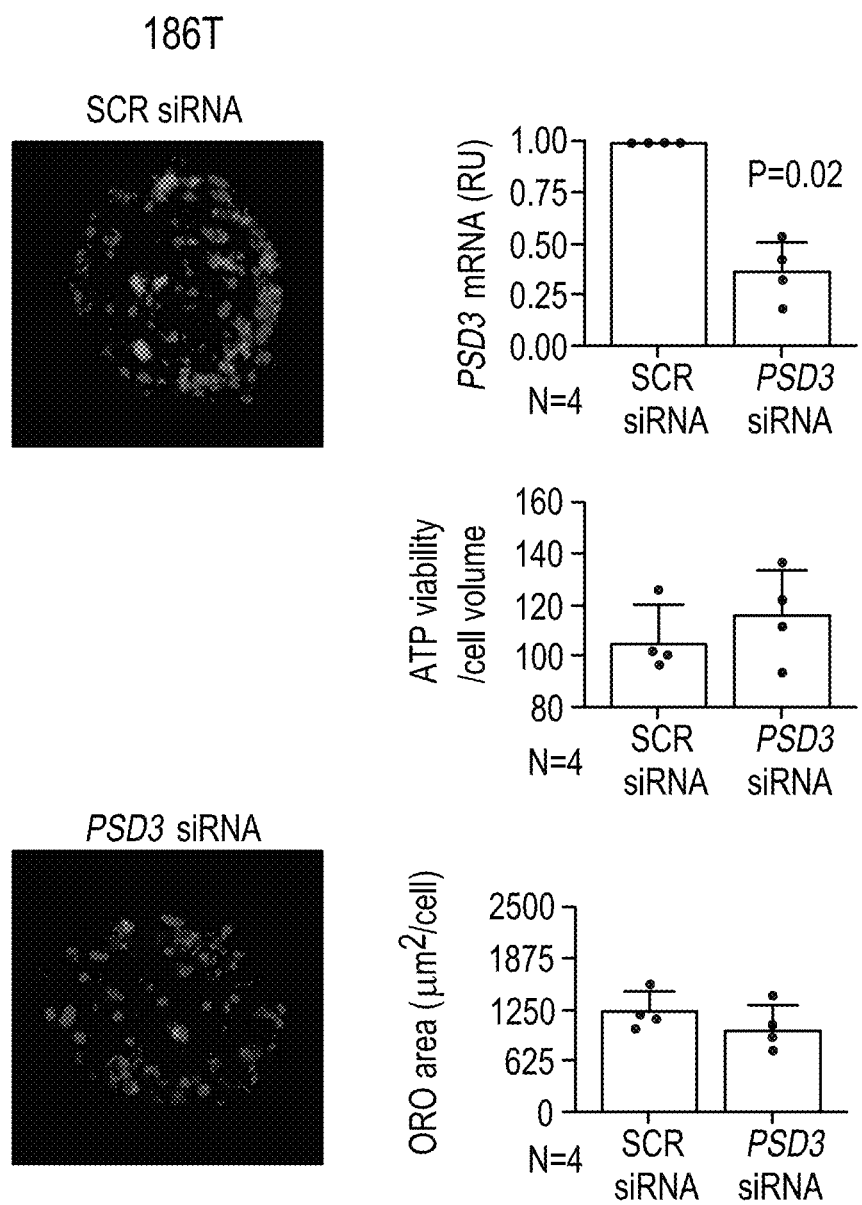

FIGS. 20A-C show that PSD3 downregulation resulted in lower levels of activated ARF6 (ARF-GTP). FIG. 20A shows that after precipitation, the active ARF6-GTP was detected by immunoblotting using an anti-ARF6 antibody provided by the kit. FIG. 20B shows that the knockdown efficiency showed ~60% reduction for PSD3 and ~75% for ARF6 as evaluated by realtime quantitative PCR analyzed by the $2^{-\Delta\Delta C_t}$ method. FIG. 20C shows the relative ARF6-GTP (active) calculated as GTP-ARF6/Calnexin. Data shown as mean±SD of the reported independent experiments. P-values calculated by Mann Whitney non-parametric test. Abbr: RU: relative units, CNX: calnexin FIGS. 21A-D shows that downregulation of PSD3 reduces the intracellular neutral lipid content in hepatocytes carrying either allele when cultured in 2D (FIGS. 21A-B). However, PSD3 silencing only reduces intracellular lipid levels in primary hepatocytes carrying the 186L allele when cultured in a 3D spheroid model (FIGS. 21C-D). P-values were calculated by Mann Whitney non-parametric test comparing SCR siRNA vs. PSD3 siRNA. Abbr: RU: relative units, CNX: calnexin.

DETAILED DESCRIPTION

Definitions

"2'-deoxyfuranosyl sugar moiety" or "2'-deoxyfuranosyl sugar" means a furanosyl sugar moiety having two hydrogens at the 2'-position. 2'-deoxyfuranosyl sugar moieties may be unmodified or modified and may be substituted at positions other than the 2'-position or unsubstituted. A β-D-2'-deoxyribosyl sugar moiety in the context of an oligonucleotide is an unsubstituted, unmodified 2'-deoxyfuranosyl and is found in naturally occurring deoxyribonucleic acids (DNA).

"2'-deoxynucleoside" means a nucleoside comprising 2'-H(H) furanosyl sugar moiety, as found in naturally occurring deoxyribonucleic acids (DNA). In certain embodiments, a 2'-deoxynucleoside may comprise a modified nucleobase or may comprise an RNA nucleobase (uracil).

"2'-O-methoxyethyl" (also 2'-MOE) refers to a 2'-O (CH$_2$)$_2$—OCH$_3$) in the place of the 2'-OH group of a ribosyl ring. A 2'-O-methoxyethyl modified sugar is a modified sugar.

"2'-MOE nucleoside" (also 2'-O-methoxyethyl nucleoside) means a nucleoside comprising a 2'-MOE modified sugar moiety.

"2'-substituted nucleoside" or "2-modified nucleoside" means a nucleoside comprising a 2'-substituted or 2'-modified sugar moiety. As used herein, "2'-substituted" or "2-modified" in reference to a sugar moiety means a sugar moiety comprising at least one 2'-substituent group other than H or OH.

"5-methylcytosine" means a cytosine with a methyl group attached to the 5 position. A 5-methyl cytosine is a modified nucleobase.

Throughout this application, the term "about" is used to indicate that a value includes the inherent variation of error for the method/device being employed to determine the value, or the variation that exists among the study subjects. Typically, the term "about" is meant to encompass approximately or less than 1%, 2%, 3%, 4%, 5%, 6%, 7%, 8%, 9%, 10%, 11%, 12%, 13%, 14%, 15%, 16%, 17%, 18%, 19% or 20% variability, depending on the situation.

The use of the term "or" in the claims is used to mean "and/or", unless explicitly indicated to refer only to alternatives or the alternatives are mutually exclusive, although the disclosure supports a definition that refers to only alternatives and "and/or."

"Antisense oligonucleotide" or "ASO" means an oligonucleotide having a nucleobase sequence that is complementary to a target nucleic acid or region or segment thereof. An antisense oligonucleotide is specifically hybridizable to a target nucleic acid or region or segment thereof, the hybridization of which results in RNase H mediated cleavage of the target nucleic acid.

"Bicyclic sugar" or "bicyclic sugar moiety" means a modified sugar moiety comprising two rings, wherein the second ring is formed via a bridge connecting two of the atoms in the first ring thereby forming a bicyclic structure. In certain embodiments, the first ring of the bicyclic sugar moiety is a furanosyl moiety. "Bicyclic nucleoside" means a nucleoside comprising a bicyclic sugar moiety.

"Conjugate group" means a group of atoms that is directly attached to an polynucleotide. On certain embodiments, conjugate groups include a conjugate moiety and a conjugate linker that attaches the conjugate moiety to the polynucleotide.

"Constrained ethyl" or "cEt" or "cEt modified sugar moiety" means a bicyclic β-D ribosyl sugar moiety wherein the second ring of the bicyclic sugar is formed via a bridge connecting the 4'-carbon and the 2'-carbon of the β-D ribosyl sugar moiety, wherein the bridge has the formula 4'-CH (CH$_3$)—O-2'. "cEt nucleoside" means a nucleoside comprising a cEt sugar moiety "Contiguous" in the context of an oligonucleotide refers to nucleosides, nucleobases, sugar moieties, or internucleoside linkages that are immediately adjacent to each other. For example, "contiguous nucleobases" means nucleobases that are immediately adjacent to each other in a sequence.

"Gapmer" means an antisense oligonucleotide comprising an internal region having a plurality of nucleosides that support RNase H cleavage positioned between external regions having one or more nucleosides, wherein the nucleosides comprising the internal region are chemically distinct from the nucleoside or nucleosides comprising the external regions. The internal region may be referred to as the "gap" and the external regions may be referred to as the "wings." In certain embodiments, an antisense oligonucleotide is a gapmer.

"Internucleoside linkage" is the covalent linkage between adjacent nucleosides in a polynucleotide. As used herein "modified internucleoside linkage" means any internucleoside linkage other than a phosphodiester internucleoside linkage. "Phosphorothioate internucleoside linkage" is a modified internucleoside linkage in which one of the non-bridging oxygen atoms of a phosphodiester internucleoside linkage is replaced with a sulfur atom.

"Linkage disequilibrium" is understood to mean the non-random association of alleles at different loci in a given population. Alleles in positive linkage disequilibrium appear together at a much higher frequency than would be expected if they were associated randomly, whereas alleles in negative linkage disquilibrium appear together at a much lower frequency than would be expected if they were associated randomly "Linked nucleosides" means adjacent nucleosides linked together by an internucleoside linkage.

"Mismatch" or "non-complementary" means a nucleobase of a first polynucleotide that is not complementary to the corresponding nucleobase of a second polynucleotide or target nucleic acid when the first and second polynucleotides are aligned. For example, nucleobases including but not limited to a universal nucleobase, inosine, and hypoxanthine, are capable of hybridizing with at least one nucleobase but are still mismatched or non-complementary with respect to nucleobase to which it hybridized. As another example, a nucleobase of a first polynucleotide that is not capable of hybridizing to the corresponding nucleobase of a second polynucleotide or target nucleic acid when the first and second polynucleotides are aligned is a mismatch or non-complementary nucleobase.

"Overhanging nucleosides" refers to unpaired nucleotides at either or both ends of a duplex formed by hybridization of an antisense RNAi oligonucleotide and a sense RNAi oligonucleotide.

The nucleobase may be naturally occurring or synthetic. The nucleobase and sugar base may each, independently, be modified or unmodified. "Modified nucleoside" means a nucleoside comprising a modified nucleobase and/or a modified sugar moiety. Modified nucleosides can include abasic nucleosides, which lack a nucleobase.

"Phosphorothioate linkage" means a modified phosphate linkage in which one of the non-bridging oxygen atoms is replaced with a sulfur atom. A phosphorothioate internucleoside linkage is a modified internucleoside linkage.

"Portion" means a defined number of contiguous (i.e., linked) nucleobases of a nucleic acid. In certain embodiments, a portion is a defined number of contiguous nucleobases of a target nucleic acid. In certain embodiments, a portion is a defined number of contiguous nucleobases of an oligomeric compound.

"Polynucleotide" means a polymer of linked nucleosides each of which can be modified or unmodified, independent one from another. Unless otherwise indicated, polynucleotides consist of 8-80 linked nucleosides. "Modified polynucleotides" means an polynucleotides, wherein at least one sugar, nucleobase, or internucleoside linkage is modified. "Unmodified polynucleotides" means polynucleotides that do not comprise any sugar, nucleobase, or internucleoside modification.

A "gene" refers to an assembly of nucleotides that encode a polypeptide and includes cDNA and genomic DNA nucleic acid molecules. In some embodiments, "gene" also refers to a non-coding nucleic acid fragment that can act as a regulatory sequence preceding (i.e., 5') and following (i.e., 3') the coding sequence.

In some embodiments, the nucleic acid molecule such as an RNA molecule described herein can hybridize to a sequence of interest, e.g., a DNA sequence or an RNA sequence. A nucleic acid molecule is "hybridizable" or "hybridized" to another nucleic acid molecule, such as a cDNA, genomic DNA, or RNA, when a single stranded form of the nucleic acid molecule can anneal to the other nucleic acid molecule under the appropriate conditions of temperature and ionic strength solution. While not limited to a particular mechanism, the most common mechanism of hybridization involves hydrogen bonding, which may be Watson-Crick, Hoogsteen or reversed Hoogsteen hydrogen bonding, between complementary nucleobases. In some embodiments, complementary nucleic acid molecules include, but are not limited to, an antisense compound and a nucleic acid target. In some embodiments, complementary nucleic acid molecules include, but are not limited to, a polynucleotide and a target nucleic acid.

"Specifically hybridizable" refers to a polynucleotide having a sufficient degree of complementarity between the polynucleotide and a target nucleic acid to induce a desired effect, while exhibiting minimal or no effects on non-target nucleic acids. In certain embodiments, specific hybridization occurs under physiological conditions.

The term "complementary" is used to describe the relationship between nucleotide bases and/or polynucleotides that are capable of hybridizing to one another, e.g., the nucleotide sequence of such polynucleotides or one or more regions thereof matches the nucleotide sequence of another polynucleotide or one or more regions thereof when the two nucleotide sequences are aligned in opposing directions. Nucleobase matches or complementary nucleobases, as described herein, include the following pairs: adenine (A) with thymine (T), adenine (A) with uracil (U), cytosine (C) with guanine (G), and 5-methyl cytosine ($^m$C) with guanine (G). Complementary polynucleotides and/or nucleic acids need not have nucleobase complementarity at each nucleoside and may include one or more nucleobase mismatches. Accordingly, the present disclosure also includes isolated polynucleotides that are complementary to sequences as disclosed or used herein as well as those substantially similar nucleic acid sequences. The degree to which two polynucleotides have matching nucleobases can be expressed in terms of "percent complementarity" or "percent complementary." In some embodiments, a polynucleotide has 70%, at least 70%, 75%, at least 75%, 80%, at least 80%, 85%, at least 85%, 90%, at least 90%, 95%, at least 95%, 97%, at least 97%, 98%, at least 98%, 99%, or at least 99% or 100% complementarity with another polynucleotide or a target nucleic acid provided herein. In embodiments wherein two polynucleotides or a polynucleotide and a target nucleic acid are "fully complementary" or "100% complementary," such polynucleotides have nucleobase matches at each nucleoside without any nucleobase mismatches. Unless otherwise indicated, percent complementarity is the percent of the nucleobases of the shorter sequence that are complementary to the longer sequence.

A DNA "coding sequence" is one of the strands of a double-stranded DNA sequence that is transcribed and translated into a polypeptide in a cell in vitro or in vivo when placed under the control of suitable regulatory sequences. "Regulatory sequences" refer to non-coding polynucleotide sequences located upstream (i.e., 5'), within, or downstream (i.e., 3') of a coding sequence, and which influence the transcription, RNA processing or stability, or translation of the associated coding sequence. Regulatory sequences may include promoters, translation leader sequences, introns, polyadenylation recognition sequences, RNA processing site, effector binding site and stem-loop structure. The boundaries of the coding sequence are determined by a start codon at the 5' (amino) terminus and a translation stop codon at the 3' (carboxyl) terminus. A coding sequence can include, but is not limited to, bacterial and archaeal polynucleotides, cDNA from mRNA, genomic DNA polynucleotides, and synthetic DNA polynucleotides. If the coding sequence is intended for expression in a eukaryotic cell, a polyadenylation signal and transcription termination sequence are typically located 3' of the coding sequence.

"PSD3" means any nucleic acid or protein of the gene, Pleckstrin and Sec7 Domain Containing 3. "PSD3 nucleic acid" means any nucleic acid encoding PSD3. For example, in certain embodiments, a PSD3 nucleic acid includes a DNA sequence encoding PSD3, an RNA sequence transcribed from DNA encoding PSD3 (including genomic DNA comprising introns and exons), and an mRNA sequence encoding PSD3. "PSD3 mRNA" means an mRNA encoding a PSD3 protein. The target may be referred to in either upper or lower case.

As used herein, the terms "sequence similarity" or "% similarity" refers to the degree of identity or correspondence between nucleic acid sequences or amino acid sequences. In the context of polynucleotides, "sequence similarity" may refer to nucleic acid sequences wherein changes in one or more nucleotide bases results in substitution of one or more amino acids, but do not affect the functional properties of the protein encoded by the polynucleotide. "Sequence similarity" may also refer to modifications of the polynucleotide, such as deletion or insertion of one or more nucleotide bases, that do not substantially affect the functional properties of the resulting transcript. It is therefore understood that the present disclosure encompasses more than the specific exemplary sequences. Methods of making nucleotide base substitutions are known, as are methods of determining the retention of biological activity of the encoded polypeptide.

Sequence similarity can be determined by sequence alignment using methods known in the field, such as, for example, BLAST, MUSCLE, Clustal (including ClustalW and ClustalX), and T-Coffee (including variants such as, for example, M-Coffee, R-Coffee, and Expresso). In some embodiments, only specific portions of two or more polynucleotide or polypeptide sequences are aligned to determine sequence identity. In some embodiments, only specific domains of two or more sequences are aligned to determine sequence similarity. A comparison window can be a segment of at least 10 to over 1000 residues, at least 20 to about 1000 residues, or at least 50 to 500 residues in which the sequences can be aligned and compared. Methods of alignment for determination of sequence identity are well-known and can be performed using publicly available databases such as BLAST. For example, in some embodiments, "percent identity" of two nucleotide sequences is determined using the algorithm of Karlin and Altschul, Proc Nat Acad Sci USA 87:2264-2268 (1990), modified as in Karlin and Altschul, Proc Nat Acad Sci USA 90:5873-5877 (1993). Such algorithms are incorporated into BLAST programs, e.g., BLAST+ or the NBLAST and XBLAST programs described in Altschul et al., J Mol Biol, 215: 403-410 (1990). BLAST protein searches can be performed with programs such as, e.g., the XBLAST program, score=50, word-length=3 to obtain amino acid sequences homologous to the protein molecules of the disclosure. Where gaps exist between two sequences, Gapped BLAST can be utilized as described in Altschul et al., Nucleic Acids Res 25(17): 3389-3402 (1997). When utilizing BLAST and Gapped BLAST programs, the default parameters of the respective programs (e.g., XBLAST and NBLAST) can be used.

Methods

In some embodiments, the present disclosure provides a method of treating or preventing fatty liver disease in a subject in need thereof, comprising administering a compound comprising a polynucleotide effective for lowering the expression of Pleckstrin and Sec7 Domain Containing 3 (PSD3) in the subject, thereby treating or preventing the fatty liver disease in the subject.

PSD3, a hepatocellular carcinoma-associated antigen, is a guanine-exchange factor that activates ADP-ribosylation factor 6 (ARF6). See, e.g., Wang et al., J Immunol 169, 1102-1109 (2002), Donaldson et al., Nat Rev Mol Cell Biol 12, 362-375 (2011), and Franco et al., EMBO J 18, 1480-1491 (1999). PSD3 is a protein with 18 annotated isoforms (Ensembl release 75) where the most common are the isoform-a (NP_056125, 1047 aa) and isoform-b (NP_996792, 513 aa). In the liver, isoform-a was discovered to be expressed at a higher level than isoform-b. In some embodiments, "PSD3" referred to herein is isoform-a of PSD3. In some embodiments, "PSD3" referred to herein is isoform-b of PSD3. In some embodiments, "PSD3" referred to herein is not limited to a particular isoform and may refer to any isoform of PSD3.

The studies disclosed herein identified, using genome-wide association studies, a PSD3 variant with a leucine to threonine substitution at amino acid position 186 (abbreviated herein as "PSD3 L186T," "L186T," or "186T allelic variant") that potentially confers protection against the entire spectrum of liver disease. Specifically, this PSD3 variant was associated with a lower prevalence of steatosis, inflammation, ballooning, and fibrosis. For subjects with liver disease and who have the PSD3 L186T variant, liver disease severity was lower across the entire spectrum. Carriers of the PSD3 L186T variant had lower plasma total cholesterol and LDL cholesterol.

It was surprisingly discovered that the L186T substitution resulted in a loss-of-function of PSD3 with respect to its guanine-exchange factor activity and catalysis of ADP-ribosylation factor 6 (ARF6) from its ARF6-GDP inactive form to the ARF6-GTP active form. Specifically, wild type PSD3 (186L) activated ARF6, while the variant, PSD3 L186T had reduced activated ARF6.

It was contemplated that downregulation of PSD3 in a subject with liver disease would confer the same protection as the loss-of-function mutant PSD3. Thus, in some embodiments, the present disclosure provides a method of lowering Pleckstrin and Sec7 Domain Containing 3 (PSD3) expression in a cell of a subject, the method comprising administering a compound comprising a polynucleotide effective for lowering the expression of PSD3 in the subject. In some embodiments, the subject has or is at risk of having fatty liver disease.

In some embodiments, the present disclosure provides a method of lowering cholesterol in a subject, the method comprising administering a compound comprising a polynucleotide effective for lowering the expression of Pleckstrin and Sec7 Domain Containing 3 (PSD3) in the subject. In some embodiments, LDL cholesterol is lowered in the subject. In some embodiments, the subject has or is at risk of having fatty liver disease.

In some embodiments, the present disclosure provides a method of reducing activation of ADP-ribosylation factor 6 (ARF6), the method comprising lowering of Pleckstrin and Sec7 Domain Containing 3 (PSD3) expression in a subject, the method comprising administering a compound comprising a polynucleotide effective for lowering the expression of PSD3 in the subject, wherein lower PSD3 expression provides for reduced activation of ARF6.

In some embodiments, the present disclosure provides a method of lowering intracellular fat content in a liver cell in a subject, the method comprising administering a compound comprising a polynucleotide effective for lowering the expression of Pleckstrin and Sec7 Domain Containing 3

(PSD3) in the subject. In some embodiments, the subject has or is at risk of having fatty liver disease.

In certain embodiments, compounds comprise or consist of a polynucleotide comprising a region that is complementary to a target nucleic acid, wherein the target nucleic acid is PSD3 RNA. In each of the embodiments described above, the compound may target PSD3 RNA. In certain embodiments, PSD3 RNA has the sequence set forth SEQ ID NO: 20 (GENBANK Accession No: NM_015310.3). In certain embodiments, contacting a cell with a compound comprising a polynucleotide complementary to SEQ ID NO: 20 reduces the amount of PSD3 RNA, and in certain embodiments reduces the amount of PSD3 protein. In certain embodiments, the compound consists of a modified oligonucleotide. In certain embodiments, the cell is in a subject in need thereof. In certain embodiments, administering the subject with a compound comprising a polynucleotide complementary to SEQ ID NO: 20 results in reduced liver damage, steatosis, liver fibrosis, liver inflammation, liver scarring or cirrhosis, liver failure in the subject. In certain embodiments, the subject is human. In certain embodiments, the compound consists of a modified oligonucleotide. In certain embodiments, the compound consists of a modified oligonucleotide and a conjugate group. In certain embodiments, the compound is an RNAi compound.

Compounds

In some embodiments, the compound is selected from an antisense oligonucleotide, an siRNA, and an ssRNAi. In certain embodiments, the compound is a ribozyme.

In some embodiments, the compound is a single-stranded polynucleotide. In some embodiments, a single-stranded polynucleotide is capable of binding to a complementary polynucleotide to form a double-stranded duplex. In some embodiments, the single-stranded polynucleotide comprises a self-complementary sequence. "Self-complementary" means that a polynucleotide can at least partially hybridize to itself. In some embodiments, the single-stranded polynucleotide comprises an RNA polynucleotide. In some embodiments, the single-stranded polynucleotide is an ssRNA, or an antisense oligonucleotide (ASO).

In some embodiments, the compound is double-stranded. Such double-stranded compounds comprise a first polynucleotide having a region complementary to a target nucleic acid (and antisense RNAi polynucleotide) and a second polynucleotide having a region complementary to the first polynucleotide (a sense RNAi polynucleotide). In some embodiments, the double-stranded compound comprises a DNA polynucleotide. In certain embodiments, the compound comprises an RNA polynucleotide. In such embodiments, the thymine nucleobases in the polynucleotides are replaced by uracil nucleobases. The polynucleotides of double-stranded compounds may include non-complementary overhanging nucleosides. In certain embodiments, the compound comprises one or more modified nucleosides in which the 2' position of the sugar contains a halogen (such as fluorine group; 2'-F) or contains an alkoxy group (such as a methoxy group; 2'-OMe). In certain embodiments, the compound comprises at least one 2'-F sugar modification and at least one 2'-OMe sugar modification. In certain embodiments, the at least one 2'-F sugar modification and at least one 2'-OMe sugar modification are arranged in an alternating pattern for at least 2, 3, 4, 5, 6, 7, 8, 9, 10, 11, 12, 13, 14, 15, 16, 17, 18, 19, or 20 contiguous nucleobases along a strand of the compound. In certain embodiments, the compound comprises one or more linkages between adjacent nucleosides other than a naturally-occurring phosphodiester linkage. Examples of such linkages include phosphoramide, phosphorothioate, and phosphorodithioate linkages. The compounds may also be chemically modified nucleic acid molecules as taught in U.S. Pat. No. 6,673,661. In other embodiments, the compound contains one or two capped strands, as disclosed, for example, by WO 00/63364, filed Apr. 19, 2000. An example of double-stranded compounds is siRNA.

In certain embodiments, compounds described herein are interfering RNA compounds (RNAi), which include double-stranded RNA compounds (also referred to as short-interfering RNA or siRNA) and single-stranded RNAi compounds (or ssRNA). Such compounds work at least in part through the RISC pathway to degrade and/or sequester a target nucleic acid (thus, include microRNA/microRNA-mimic compounds). As used herein, the term "siRNA" is meant to be equivalent to other terms used to describe nucleic acid molecules that are capable of mediating sequence-specific RNAi, for example, short interfering RNA (siRNA), double-stranded RNA (dsRNA), micro-RNA (miRNA), short hairpin RNA (shRNA), short interfering polynucleotide, short interfering nucleic acid, short interfering modified polynucleotide, chemically modified siRNA, post-transcriptional gene silencing RNA (ptgsRNA), and others. In addition, as used herein, the term "RNAi" is meant to be equivalent to other terms used to describe sequence-specific RNA interference, such as post transcriptional gene silencing, translational inhibition, or epigenetics.

In certain antisense activities, hybridization of a compound described herein to a target nucleic acid results in recruitment of a protein that cleaves the target nucleic acid. For example, certain compounds described herein result in RNase H mediated cleavage of the target nucleic acid. RNase H is a cellular endonuclease that cleaves the RNA strand of an RNA:DNA duplex. The DNA in such an RNA:DNA duplex need not be unmodified DNA. In certain embodiments, compounds described herein are sufficiently "DNA-like" to elicit RNase H activity. Further, in certain embodiments, one or more non-DNA-like nucleoside in the gap of a gapmer is tolerated.

In certain antisense activities, compounds described herein or a portion of the compound is loaded into an RNA-induced silencing complex (RISC), ultimately resulting in cleavage of the target nucleic acid. For example, certain compounds described herein result in cleavage of the target nucleic acid by Argonaute. Compounds that are loaded into RISC are RNAi compounds. RNAi compounds may be double-stranded (siRNA) or single-stranded (ssRNA).

RNAi Compounds

RNAi compounds comprise an antisense RNAi polynucleotide and optionally a sense RNAi polynucleotide. RNAi compounds may also comprise terminal groups and/or conjugate groups which may be attached to the antisense RNAi polynucleotide or the sense RNAi polynucleotide (when present).

RNAi compounds comprising an antisense RNAi polynucleotide and a sense RNAi polynucleotide may form a duplex, because the sense RNAi polynucleotide comprises an antisense-hybridizing region that is complementary to the antisense RNAi polynucleotide. In certain embodiments, each nucleobase of the antisense RNAi polynucleotide and the sense RNAi polynucleotide are complementary to one another. In certain embodiments, the two RNAi polynucleotide have at least one mismatch relative to one another.

In certain embodiments, the antisense hybridizing region constitutes the entire length of the sense RNAi polynucleotide and the antisense RNAi polynucleotide. In certain embodiments, one or both of the antisense RNAi polynucleotide and the sense RNAi polynucleotide comprise additional nucleosides at one or both ends that do not hybridize (overhanging nucleosides). In certain embodiments, overhanging nucleosides are DNA. In certain embodiments, overhanging nucleosides are linked to each other (where there is more than one) and to the first non-overhanging nucleoside with phosphorothioate linkages.

Polynucleotides

In some embodiments, the present disclosure provides a polynucleotide consisting of 8 to 50 linked nucleosides and having at least 90% sequence complementarity to an equal length portion of a nucleic acid encoding PSD3. In some embodiments, the polynucleotide consists of 10 to 30 linked nucleosides and has at least 90% sequence complementarity an equal length portion of a nucleic acid encoding PSD3. In some embodiments, the polynucleotide consists of 12 to 20 linked nucleosides and has at least 90% sequence complementarity to an equal length portion of a nucleic acid encoding PSD3.

In some embodiments, the polynucleotide consists of 8 to 80 linked nucleosides. In some embodiments, the polynucleotide consists of 8 to 50 linked nucleosides. In some embodiments, the polynucleotide consists of 10 to 30 linked nucleosides. In some embodiments, the polynucleotide consists of 12 to 30 linked nucleosides. In some embodiments, the polynucleotide consists of 12 to 22 linked nucleosides. In some embodiments, the polynucleotide consists of 14 to 30 linked nucleosides. In some embodiments, the polynucleotide consists of 15 to 30 linked nucleosides. In some embodiments, the polynucleotide consists of 16 to 30 linked nucleosides. In some embodiments, the polynucleotide consists of 17 to 30 linked nucleosides. In some embodiments, the polynucleotide consists of 12 to 20 linked nucleosides. In some embodiments, the polynucleotide consists of 15 to 20 linked nucleosides. In some embodiments, the polynucleotide consists of 16 to 20 linked nucleosides. In some embodiments, the polynucleotide consists of 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 5 57, 58, 59, 60, 61, 62, 63, 64, 65, 66, 67, 68, 69, 70, 71, 72, 73, 74, 75, 76, 77, 78, 79, or 80 linked nucleosides. In some embodiments, the polynucleotide consists of about 8, about 9, about 10, about 11, about 12, about 13, about 14, about 15, about 16, about 17, about 18, about 19, or about 20 linked nucleosides.

In some embodiments, the polynucleotide has a nucleobase sequence at least 50%, at least 55%, at least 60%, at least 65%, at least 70%, at least 75%, at least 80%, at least 85%, at least 90%, at least 95%, or about 100% complementary to an equal length portion of a nucleic acid encoding PSD3 (SEQ ID NOs: 2-18).

In some embodiments, the polynucleotide comprises a nucleotide sequence capable of hybridizing with an equal length portion of a nucleic acid encoding PSD3. In some embodiments, the nucleic acid encoding PSD3 comprises SEQ ID NO. 2-18. In some embodiments, the nucleic acid is RNA.

In some embodiments, the polynucleotide has a nucleobase sequence at least 50%, at least 55%, at least 60%, at least 65%, at least 70%, at least 75%, at least 80%, at least 85%, at least 90%, at least 95%, or about 100% complementary to an equal length portion of a transcription initiation site, a translation initiation site, 5'-untranslated sequence, 3'-untranslated sequence, coding sequence, a pre-mRNA sequence, and/or an intron/exon junction of an mRNA encoding the PSD3 protein. In some embodiments, the polynucleotide has a nucleobase sequence at least 90%, at least 91%, at least 92%, at least 93%, at least 94%, at least 95%, at least 96%, at least 97%, at least 98%, at least 99%, or about 100% complementary to equal length portion of a transcription initiation site, a translation initiation site, 5'-untranslated sequence, 3'-untranslated sequence, coding sequence, a pre-mRNA sequence, and/or an intron/exon junction of an mRNA encoding the PSD3 protein. In some embodiments, the polynucleotide has a nucleobase sequence capable of hybridizing with an equal length portion or all of transcription initiation site, a translation initiation site, 5'-untranslated sequence, 3'-untranslated sequence, coding sequence, a pre-mRNA sequence, and/or an intron/exon junction of an mRNA encoding the PSD3 protein. In some embodiments, the polynucleotide has a nucleobase sequence at least 50%, at least 55%, at least 60%, at least 65%, at least 70%, at least 75%, at least 80%, at least 85%, at least 90%, at least 95%, or about 100% complementary to an equal length portion of any one of SEQ ID NOs: 2-18. In some embodiments, the polynucleotide has a nucleobase sequence at least 90%, at least 91%, at least 92%, at least 93%, at least 94%, at least 95%, at least 96%, at least 97%, at least 98%, at least 99%, or about 100% complementary to an equal length portion of any one of SEQ ID NOs: 2-18. In some embodiments, the polynucleotide has a nucleobase sequence capable of hybridizing with an equal length portion of any one of SEQ ID NOs: 2-18.

In some embodiments, the polynucleotide comprises at least one modification selected from at least one modified internucleoside linkage, at least one modified sugar moiety, and at least one modified nucleobase.

In some embodiments, the polynucleotide comprises at least one modified internucleoside linkage. The naturally occurring internucleoside linkage of RNA and DNA is a 3' to 5' phosphodiester linkage. In some embodiments, the polynucleotides described herein having one or more modified, i.e. non-naturally occurring, internucleoside linkages are often selected over polynucleotides having naturally occurring internucleoside linkages because of desirable properties such as, for example, enhanced cellular uptake, enhanced affinity for target nucleic acids, and increased stability in the presence of nucleases.

In some embodiments, nucleosides of modified polynucleotides may be linked together using any internucleoside linkage. The two main classes of internucleoside linking groups are defined by the presence or absence of a phosphorus atom. Representative phosphorus-containing internucleoside linkages include but are not limited to phosphates, which contain a phosphodiester bond ("P=O") (also referred to as unmodified or naturally occurring linkages), phosphotriesters, methylphosphonates, phosphoramidates, and phosphorothioates ("P=S"), and phosphorodithioates ("HS-P=S"). Representative non-phosphorus containing internucleoside linking groups include but are not limited to methylenemethylimino (—CH$_2$—N(CH$_3$)—O—CH$_2$—), thiodiester, thionocarbamate (—O—C(=O)(NH)—S—); siloxane (—O—SiH$_2$—O—); and N,N'-dimethylhydrazine (—CH$_2$—N(CH$_3$)—N(CH$_3$)—). Modified internucleoside linkages, compared to naturally occurring phosphate linkages, can be used to alter, typically increase, nuclease resistance of the polynucleotide. In some embodiments, internucleoside linkages having a chiral atom are prepared as a racemic mixture, or as separate enantiomers. Methods of preparation of phosphorous-containing and non-phosphorous-containing internucleoside linkages are known to those skilled in the art.

Representative chiral internucleoside linkages include but are not limited to alkylphosphonates and phosphorothioates. Modified polynucleotides disclosed herein comprising internucleoside linkages having a chiral center can be prepared as populations of polynucleotides comprising stereorandom internucleoside linkages, or as populations of polynucleotides comprising phosphorothioate linkages in particular stereochemical configurations. In certain embodiments, populations of polynucleotides comprise phosphorothioate internucleoside linkages wherein all of the phosphorothioate internucleoside linkages are stereorandom. Such polynucleotides can be generated using synthetic methods that result in random selection of the stereochemical configuration of each phosphorothioate linkage. Nonetheless, each individual phosphorothioate of each individual o polynucleotide molecule has a defined stereoconfiguration. In certain embodiments, populations of polynucleotides are enriched for polynucleotides comprising one or more particular phosphorothioate internucleoside linkages in a particular, independently selected stereochemical configuration. In certain embodiments, the particular configuration of the particular phosphorothioate linkage is present in at least 65% of the molecules in the population. In certain embodiments, the particular configuration of the particular phosphorothioate linkage is present in at least 70% of the molecules in the population. In certain embodiments, the particular configuration of the particular phosphorothioate linkage is present in at least 80% of the molecules in the population. In certain embodiments, the particular configuration of the particular phosphorothioate linkage is present in at least 90% of the molecules in the population. In certain embodiments, the particular configuration of the particular phosphorothioate linkage is present in at least 99% of the molecules in the population. Such chirally enriched populations of polynucleotides can be generated using synthetic methods known in the art, e.g., methods described in Oka et al., *JACS* 125, 8307 (2003), Wan et al. *Nuc. Acid. Res.* 42, 13456 (2014), and WO 2017/015555. In certain embodiments, a population of polynucleotides is enriched for polynucleotides having at least one indicated phosphorothioate in the (Sp) configuration. In certain embodiments, a population of polynucleotides is enriched for polynucleotides having at least one phosphorothioate in the (Rp) configuration. In certain embodiments, polynucleotides comprising (Rp) and/or (Sp) phosphorothioates comprise one or more of the following formulas, respectively, wherein "B" indicates a nucleobase:

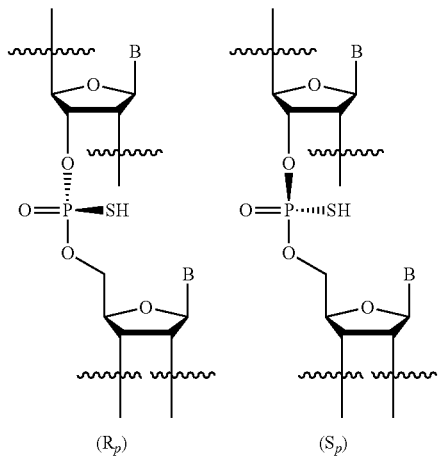

Unless otherwise indicated, chiral internucleoside linkages of RNAi polynucleotides described herein can be stereorandom or in a particular stereochemical configuration. Methods of preparation of phosphorous-containing and non-phosphorous-containing internucleoside linkages are known to those skilled in the art.

Neutral internucleoside linkages include, without limitation, phosphotriesters, methylphosphonates, MMI (3'-$CH_2$—$N(CH_3)$—O-5'), amide-3 (3'-$CH_2$—C(=O)—N(H)-5'), amide-4 (3'-$CH_2$—N(H)—C(=O)-5'), formacetal (3'-O—$CH_2$—O-5'), methoxypropyl, and thioformacetal (3'-S—$CH_2$—O-5'). Further neutral internucleoside linkages include nonionic linkages comprising siloxane (dialkylsiloxane), carboxylate ester, carboxamide, sulfide, sulfonate ester and amides (see, for example: Carbohydrate Modifications in Antisense Research; Y. S. Sanghvi and P. D. Cook, Eds., ACS Symposium Series 580; Chapters 3 and 4, 40-65). Further neutral internucleoside linkages include nonionic linkages comprising mixed N, O, S and $CH_2$ component parts.

In certain embodiments, polynucleotides (such as antisense RNAi polynucleotides and/or sense RNAi polynucleotides) comprise one or more inverted nucleoside, as shown below:

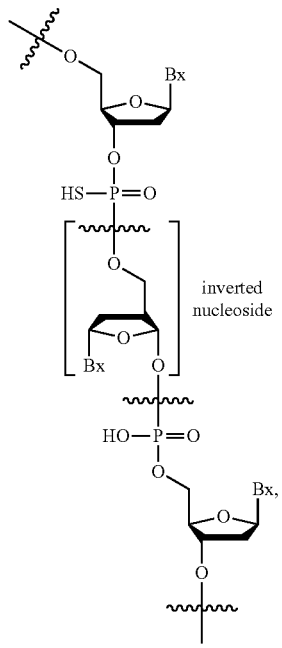

wherein each Bx independently represents any nucleobase.

In certain embodiments, an inverted nucleoside is terminal (i.e., the last nucleoside on one end of an oligonucleotide) and so only one internucleoside linkage depicted above will be present. In certain such embodiments, additional features (such as a conjugate group) may be attached to the inverted nucleoside. Such terminal inverted nucleosides can be attached to either or both ends of a polynucleotide.

In certain embodiments, such groups lack a nucleobase and are referred to herein as inverted sugar moieties. In certain embodiments, an inverted sugar moiety is terminal (i.e., attached to the last nucleoside on one end of a polynucleotide) and so only one internucleoside linkage above will be present. In certain such embodiments, additional features (such as a conjugate group) may be attached to the inverted sugar moiety. Such terminal inverted sugar moieties can be attached to either or both ends of a polynucleotide.

In certain embodiments, nucleic acids can be linked 2' to 5' rather than the standard 3' to 5' linkage. Such a linkage is illustrated below.

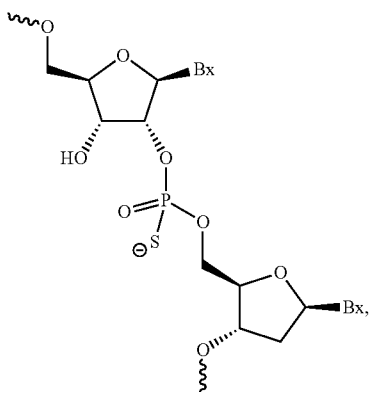

wherein each Bx represents any nucleobase.

In some embodiments, polynucleotides comprise modified internucleoside linkages arranged along the polynucleotide or region thereof in a defined pattern or modified internucleoside linkage motif. In some embodiments, internucleoside linkages are arranged in a gapped motif. In such embodiments, the internucleoside linkages in each of two wing regions are different from the internucleoside linkages in the gap region. In some embodiments, the internucleoside linkages in the wings are phosphodiester, and the internucleoside linkages in the gap are phosphorothioate. The nucleoside motif is independently selected, so such polynucleotides having a gapped internucleoside linkage motif may or may not have a gapped nucleoside motif, and if it does have a gapped nucleoside motif, the wing and gap lengths may or may not be the same.

In some embodiments, polynucleotides comprise a region having an alternating internucleoside linkage motif. In some embodiments, polynucleotides comprise a region of uniformly modified internucleoside linkages. In such embodiments, the polynucleotide comprises a region that is uniformly linked by phosphorothioate internucleoside linkages. In some embodiments, the polynucleotide is uniformly linked by phosphorothioate. In some embodiments, each internucleoside linkage of the polynucleotide is selected from phosphodiester and phosphorothioate. In some embodiments, each internucleoside linkage of the polynucleotides is selected from phosphodiester and phosphorothioate, and at least one internucleoside linkage is phosphorothioate.

In some embodiments, the polynucleotide comprises at least 6 phosphorothioate internucleoside linkages. In some embodiments, the polynucleotide comprises at least 8 phosphorothioate internucleoside linkages. In some embodiments, the polynucleotide comprises at least 10 phosphorothioate internucleoside linkages. In some embodiments, the polynucleotide comprises at least one block of at least 6 consecutive phosphorothioate internucleoside linkages. In some embodiments, the polynucleotide comprises at least one block of at least 8 consecutive phosphorothioate internucleoside linkages. In some embodiments, the polynucleotide comprises at least one block of at least 10 consecutive phosphorothioate internucleoside linkages. In some embodiments, the polynucleotide comprises at least one block of at least one 12 consecutive phosphorothioate internucleoside linkages. In some such embodiments, at least one such block is located at the 3' end of the polynucleotide. In some such embodiments, at least one such block is located within 3 nucleosides of the 3' end of the polynucleotide.

In some embodiments, polynucleotides comprise one or more methylphosphonate linkages. In some embodiments, polynucleotides having a gapmer nucleoside motif comprise a linkage motif comprising all phosphorothioate linkages except for one or two methylphosphonate linkages. In some embodiments, one methylphosphonate linkage is in the central gap of a polynucleotide having a gapmer nucleoside motif.

In some embodiments, it is desirable to arrange the number of phosphorothioate internucleoside linkages and phosphodiester internucleoside linkages to maintain nuclease resistance. In some embodiments, it is desirable to arrange the number and position of phosphorothioate internucleoside linkages and the number and position of phosphodiester internucleoside linkages to maintain nuclease resistance. In some embodiments, the number of phosphorothioate internucleoside linkages may be decreased and the number of phosphodiester internucleoside linkages may be increased. In some embodiments, the number of phosphorothioate internucleoside linkages may be decreased and the number of phosphodiester internucleoside linkages may be increased while still maintaining nuclease resistance. In some embodiments, it is desirable to decrease the number of phosphorothioate internucleoside linkages while retaining nuclease resistance. In some embodiments it is desirable to increase the number of phosphodiester internucleoside linkages while retaining nuclease resistance.

In some embodiments, polynucleotides targeted to a target nucleic acid, e.g., a sequence encoding the PSD3 protein, comprise one or more modified internucleoside linkages. In some embodiments, the at least one modified internucleoside linkage of the modified polynucleotide is a phosphorothioate internucleoside linkage. In some embodiments, each internucleoside linkage of a polynucleotide is a phosphorothioate internucleoside linkage.

In some embodiments, the modified polynucleotide comprises at least one modified sugar moiety. In some embodiments, the at least one modified sugar is a bicyclic sugar, 2'-O-methyoxyethyl, 2'-F, or 2'-O-Methyl.

In some embodiments, sugar moieties are non-bicyclic modified sugar moieties. In some embodiments, modified sugar moieties are bicyclic or tricyclic sugar moieties. In some embodiments, modified sugar moieties are sugar surrogates. Such sugar surrogates may comprise one or more substitutions corresponding to those of other types of modified sugar moieties. In some embodiments, modified sugar moieties are non-bicyclic modified sugar moieties comprising a furanosyl ring with one or more acyclic substituent, including but not limited to substituents at the 2', 3', 4', and/or 5' positions. In some embodiments, one or more acyclic substituent of non-bicyclic modified sugar moieties is branched.

Nucleosides comprising modified sugar moieties, such as non-bicyclic modified sugar moieties, are referred to by the position(s) of the substitution(s) on the sugar moiety of the nucleoside. For example, nucleosides comprising 2'-substituted or 2-modified sugar moieties are referred to as 2'-substituted nucleosides or 2-modified nucleosides. Examples of 2'-substituent groups suitable for non-bicyclic modified sugar moieties include but are not limited to: 2'-F, 2'-OCH$_3$ ("OMe" or "O-methyl"), and 2'-O(CH$_2$)$_2$OCH$_3$ ("MOE"). In some embodiments, 2'-substituent groups are selected from among: halo, allyl, amino, azido, SH, CN, OCN, $CF_3$, $OCF_3$, O—$C_1$-$C_{10}$ alkoxy, O—$C_1$-$C_{10}$ substituted alkoxy, O—$C_1$-$C_{10}$ alkyl, O—$C_1$-$C_{10}$ substituted alkyl, S-alkyl, N($R_m$)-alkyl, O-alkenyl, S-alkenyl, N($R_m$)-alkenyl, O-alkynyl, S-alkynyl, N($R_m$)-alkynyl, O-alkylenyl-O-alkyl, alkynyl, alkaryl, aralkyl, O-alkaryl, O-aralkyl, $O(CH_2)_2SCH_3$, $O(CH_2)_2ON(R_m)(R_n)$ or $OCH_2C(=O)$—$N(R_m)(R_n)$, where each $R_m$ and $R_n$ is, independently, H, an amino protecting group, or substituted or unsubstituted $C_1$-$C_{10}$ alkyl, —$O(CH_2)_2ON(CH_3)_2$ ("DMAOE"), 2'-$OCH_2OCH_2N(CH_2)_2$ ("DMAEOE"), and the 2'-substituent groups described in Cook et al., U.S. Pat. No. 6,531,584; Cook et al., U.S. Pat. No. 5,859,221; and Cook et al., U.S. Pat. No. 6,005,087. Some embodiments of these 2'-substituent groups can be further substituted with one or more substituent groups independently selected from among: hydroxyl, amino, alkoxy, carboxy, benzyl, phenyl, nitro ($NO_2$), thiol, thioalkoxy, thioalkyl, halogen, alkyl, aryl, alkenyl and alkynyl. In some embodiments, a 2'-substituted nucleoside or 2'-non-bicyclic modified nucleoside comprises a sugar moiety comprising a linear 2'-substituent group selected from: F, $NH_2$, $N_3$, $OCF_3$, $OCH_3$, $O(CH_2)_3NH_2$, $CH_2CH=CH_2$, $OCH_2CH=CH_2$, $OCH_2CH_2OCH_3$, $O(CH_2)_2SCH_3$, $O(CH_2)_2ON(R_m)(R_n)$, $O(CH_2)_2O(CH_2)_2N(CH_3)_2$, and N-substituted acetamide ($OCH_2C(=O)$—$N(R_m)(R_n)$), where each $R_m$ and $R_n$ is independently, H, an amino protecting group, or substituted or unsubstituted $C_1$-$C_{10}$ alkyl.

In some embodiments, a 2'-substituted nucleoside or 2'-non-bicyclic modified nucleoside comprises a sugar moiety comprising a linear 2'-substituent group selected from: F, $OCF_3$, $OCH_3$, $OCH_2CH_2OCH_3$, $O(CH_2)_2SCH_3$, $O(CH_2)_2ON(CH_3)_2$, $O(CH_2)_2O(CH_2)_2N(CH_3)_2$, and $OCH_2C(=O)$—$N(H)CH_3$ ("NMA"). In some embodiments, a 2'-substituted nucleoside or 2'-non-bicyclic modified nucleoside comprises a sugar moiety comprising a linear 2'-substituent group selected from: F, $OCH_3$, and $OCH_2CH_2OCH_3$.

In certain embodiments, non-bicyclic modified sugar moieties comprise a substituent group at the 4'-position. Examples of suitable 4'-substituent groups include but are not limited to alkoxy (e.g., methoxy), alkyl, and those described in Manoharan et al., WO 2015/106128. In certain embodiments, non-bicyclic modified sugar moieties comprise a substituent group at the 3'-position. Examples of substituent groups suitable for the 3'-position of modified sugar moieties include but are not limited to alkoxy (e.g., methoxy), alkyl (e.g., methyl, ethyl). In certain embodiments, non-bicyclic modified sugar moieties comprise a substituent group at the 5'-position. Examples of substituent groups suitable for the 5'-position of modified sugar moieties include but are not limited to: alkyl (e.g. methyl (R or S), vinyl, and 5'-alkoxy (e.g. methoxy). In some embodiments, non-bicyclic modified sugars comprise more than one non-bridging sugar substituent, for example, 2'-F-5'-methyl sugar moieties and the modified sugar moieties and modified nucleosides described in Migawa et al., WO 2008/101157 and Rajeev et al., US2013/0203836.

In naturally occurring nucleic acids, sugars are linked to one another 3' to 5'. In certain embodiments, polynucleotides include one or more nucleoside or sugar moiety linked at an alternative position, for example at the 2' or inverted 5' to 3'. For example, where the linkage is at the 2' position, the 2'-substituent groups may instead be at the 3'-position.

Certain modified sugar moieties comprise a bridging sugar substituent that forms a second ring resulting in a bicyclic sugar moiety. Nucleosides comprising such bicyclic sugar moieties have been referred to as bicyclic nucleosides (BNAs), locked nucleosides, or conformationally restricted nucleosides (CRN). Certain such compounds are described in US Patent Publication No. 2013/0190383; and PCT publication WO 2013/036868. In some such embodiments, the bicyclic sugar moiety comprises a bridge between the 4' and the 2' furanose ring atoms. In certain such embodiments, the furanose ring is a ribose ring. Examples of such 4' to 2' bridging sugar substituents include but are not limited to: 4'-$CH_2$-2', 4'-$(CH_2)_2$-2', 4'-$(CH_2)_3$-2', 4'-$CH_2$—O-2' ("LNA"), 4'-$CH_2$—S-2', 4'-$(CH_2)_2$—O-2' ("ENA"), 4'-CH($CH_3$)—O-2' (referred to as "constrained ethyl" or "cEt" when in the S configuration), 4'-$CH_2$— O—$CH_2$-2', 4'-$CH_2$—N(R)-2', 4'-CH($CH_2OCH_3$)—O-2' ("constrained MOE" or "cMOE") and analogs thereof (see, e.g., Seth et al., U.S. Pat. No. 7,399,845, Bhat et al., U.S. Pat. No. 7,569,686, Swayze et al., U.S. Pat. No. 7,741,457, and Swayze et al., U.S. Pat. No. 8,022,193), 4'-C($CH_3$)($CH_3$)—O-2' and analogs thereof (see, e.g., Seth et al., U.S. Pat. No. 8,278,283), 4'-$CH_2$—N($OCH_3$)-2' and analogs thereof (see, e.g., Prakash et al., U.S. Pat. No. 8,278,425), 4'-$CH_2$—O—N($CH_3$)-2' (see, e.g., Allerson et al., U.S. Pat. No. 7,696,345 and Allerson et al., U.S. Pat. No. 8,124,745), 4'-$CH_2$—C(H)($CH_3$)-2' (see, e.g., Zhou, et al., J. Org. Chem., 2009, 74, 118-134), 4'-$CH_2$—C(=$CH_2$)-2' and analogs thereof (see, e.g., Seth et al., U.S. Pat. No. 8,278,426), 4'-C($R_aR_b$)—N(R)—O-2', 4'-C($R_aR_b$)—O—N(R)-2', 4'-$CH_2$—O—N(R)-2', and 4'-$CH_2$—N(R)—O-2', wherein each R, $R_a$, and $R_b$ is, independently, H, a protecting group, or $C_1$-$C_{12}$alkyl (see, e.g. Imanishi et al., U.S. Pat. No. 7,427,672).

In some embodiments, such 4' to 2' bridges independently comprise from 1 to 4 linked groups independently selected from: —[C($R_a$)($R_b$)]$_n$—, —[C($R_a$)($R_b$)]$_n$—O—, —C($R_a$) =C($R_b$)—, —C($R_a$)=N—, —C(=$NR_a$)—, —C(=O)—, —C(=S)—, —O—, —Si($R_a$)$_2$—, —S(=O)$_x$—, and —N($R_a$)—; wherein: x is 0, 1, or 2; n is 1, 2, 3, or 4; each $R_a$ and $R_b$ is, independently, H, a protecting group, hydroxyl, $C_1$-$C_{12}$ alkyl, substituted $C_1$-$C_{12}$ alkyl, $C_2$-$C_{12}$ alkenyl, substituted $C_2$-$C_{12}$ alkenyl, $C_2$-$C_{12}$ alkynyl, substituted $C_2$-$C_{12}$ alkynyl, $C_5$-$C_{20}$ aryl, substituted $C_5$-$C_{20}$ aryl, heterocycle radical, substituted heterocycle radical, heteroaryl, substituted heteroaryl, $C_5$-$C_7$ alicyclic radical, substituted $C_5$-$C_7$ alicyclic radical, halogen, $OJ_1$, $NJ_1J_2$, $SJ_1$, $N_3$, $COOJ_1$, acyl (C(=O)—H), substituted acyl, CN, sulfonyl (S(=O)$_2$-$J_1$), or sulfoxyl (S(=O)-$J_1$); and each $J_1$ and $J_2$ is, independently, H, $C_1$-$C_{12}$ alkyl, substituted $C_1$-$C_{12}$ alkyl, $C_2$-$C_{12}$ alkenyl, substituted $C_2$-$C_{12}$ alkenyl, $C_2$-$C_{12}$ alkynyl, substituted $C_2$-$C_{12}$ alkynyl, $C_5$-$C_{20}$ aryl, substituted $C_5$-$C_{20}$ aryl, acyl (C(=O)—H), substituted acyl, a heterocycle radical, a substituted heterocycle radical, $C_1$-$C_{12}$ aminoalkyl, substituted $C_1$-$C_{12}$ aminoalkyl, or a protecting group.

Additional bicyclic sugar moieties are known in the art, see, for example: Freier et al., Nucleic Acids Research, 1997, 25(22), 4429-4443, Albaek et al., J. Org. Chem., 2006, 71, 7731-7740, Singh et al., Chem. Commun., 1998, 4, 455-456; Koshkin et al., Tetrahedron, 1998, 54, 3607-3630; Wahlestedt et al., Proc. Natl. Acad. Sci. U.S.A, 2000, 97, 5633-5638; Kumar et al., Bioorg. Med. Chem. Lett., 1998, 8, 2219-2222; Singh et al., J. Org. Chem., 1998, 63, 10035-10039; Srivastava et al., J. Am. Chem. Soc., 20017, 129, 8362-8379; Elayadi et al., Curr. Opinion Invens. Drugs, 2001, 2, 558-561; Braasch et al., Chem. Biol., 2001, 8, 1-7; Orum 10 et al., Curr. Opinion Mol. Ther., 2001, 3, 239-243; Wengel et al., U.S. Pat. No. 7,053,207, Imanishi et al., U.S. Pat. No. 6,268,490, Imanishi et al., U.S. Pat. No. 6,770,748, Imanishi et al., U.S. RE44,779; Wengel et al., U.S. Pat. No. 6,794,499, Wengel et al., U.S. Pat. No. 6,670,461; Wengel et al., U.S. Pat. No. 7,034,133, Wengel et al., U.S. Pat. No. 8,080,644; Wengel et al., U.S. Pat. No. 8,034,909; Wengel et al., U.S. Pat. No. 8,153,365; Wengel et al., U.S. Pat. No. 7,572,582; and Ramasamy et al., U.S. Pat. No. 6,525,191, Torsten et al., WO 2004/106356, Wengel et al., WO 91999/014226; Seth et al., WO 2007/134181; Seth et al., U.S. Pat. No. 7,547,684; Seth et al., U.S. Pat. No. 7,666,854; Seth et al., U.S. Pat. No. 8,088,746; Seth et al., U.S. Pat. No. 7,750,131; Seth et al., U.S. Pat. No. 8,030,467; Seth et al., U.S. Pat. No. 8,268,980; Seth et al., U.S. Pat. No. 8,546,556; Seth et al., U.S. Pat. No. 8,530,640; Migawa et al., U.S. Pat. No. 9,012,421; Seth et al., U.S. Pat. No. 8,501,805; and U.S. Patent Publication Nos. Allerson et al., US2008/0039618 and Migawa et al., US2015/0191727.

In some embodiments, bicyclic sugar moieties and nucleosides incorporating such bicyclic sugar moieties are further defined by isomeric configuration. For example, an LNA nucleoside (described herein) may be in the α-L configuration or in the β-D configuration.

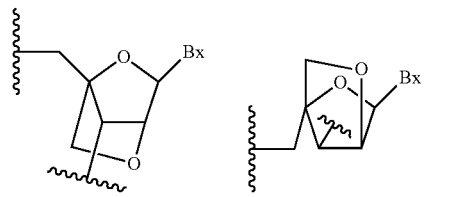

LNA (β-D-configuration)   α-L-LNA (α-L-configuration)
bridge = 4'-CH$_2$—O-2'     bridge = 4'-CH$_2$—O-2'

α-L-methyleneoxy (4'-CH$_2$—O-2') or α-L-LNA bicyclic nucleosides have been incorporated into polynucleotides that showed antisense activity (Frieden et al., Nucleic Acids Research, 2003, 21, 6365-6372). The addition of locked nucleic acids to siRNAs has been shown to increase siRNA stability in serum, and to reduce off-target effects (Elmen, J. et al., (2005) Nucleic Acids Research 33(1):439-447; Mook, O R. et al., (2007) Mal Cane Ther 6(3):833-843; Grunweller, A. et al., (2003) Nucleic Acids Research 31(12):3185-3193). Herein, general descriptions of bicyclic nucleosides include both isomeric configurations. When the positions of specific bicyclic nucleosides (e.g., LNA or cEt) are identified in exemplified embodiments herein, they are in the β-D configuration, unless otherwise specified.

In some embodiments, modified sugar moieties comprise one or more non-bridging sugar substituent and one or more bridging sugar substituent (e.g., 5'-substituted and 4'-2' bridged sugars). In some embodiments, modified sugar moieties are sugar surrogates. In some such embodiments, the oxygen atom of the sugar moiety is replaced, e.g., with a sulfur, carbon or nitrogen atom. In some such embodiments, such modified sugar moieties also comprise bridging and/or non-bridging substituents as described herein. For example, certain sugar surrogates comprise a 4'-sulfur atom and a substitution at the 2'-position (see, e.g., Bhat et al., U.S. Pat. No. 7,875,733 and Bhat et al., U.S. Pat. No. 7,939,677) and/or the 5' position.

In some embodiments, sugar surrogates comprise rings having other than 5 atoms. For example, in some embodiments, a sugar surrogate comprises a six-membered tetrahydropyran ("THP"). Such tetrahydropyrans may be further modified or substituted. Nucleosides comprising such modified tetrahydropyrans include but are not limited to hexitol nucleic acid ("HNA"), anitol nucleic acid ("ANA"), manitol nucleic acid ("MNA") (see e.g., Leumann, C J. Bioorg. & Med. Chem. 2002, 10, 841-854), fluoro HNA:

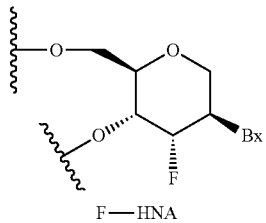

F—HNA ("F-HNA", see e.g., Swayze et al., U.S. Pat. No. 8,088,904; Swayze et al., U.S. Pat. No. 8,440,803; Swayze et al., U.S.; and Swayze et al., U.S. Pat. No. 9,005,906, F-HNA can also be referred to as a F-THP or 3'-fluoro tetrahydropyran), and nucleosides comprising additional modified THP compounds having the formula:

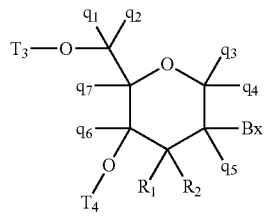

wherein, independently, for each of said modified THP nucleoside: Bx is a nucleobase moiety; $T_3$ and $T_4$ are each, independently, an internucleoside linking group linking the modified THP nucleoside to the remainder of a polynucleotide, or one of $T_3$ and $T_4$ is an internucleoside linking group linking the modified THP nucleoside to the remainder of a polynucleotide and the other of $T_3$ and $T_4$ is H, a hydroxyl protecting group, a linked conjugate group, or a 5' or 3'-terminal group; $q_1$, $q_2$, $q_3$, $q_4$, $q_5$, $q_6$ and $q_7$ are each, independently, H, $C_1$-$C_6$ alkyl, substituted $C_1$-$C_6$ alkyl, $C_2$-$C_6$ alkenyl, substituted $C_2$-$C_6$ alkenyl, $C_2$-$C_6$ alkynyl, or substituted $C_2$-$C_6$ alkynyl; and each of $R_1$ and $R_2$ is independently selected from among: hydrogen, halogen, substituted or unsubstituted alkoxy, $NJ_1J_2$, $SJ_1$, $N_3$, OC(=X)$J_1$, OC(=X)$NJ_1J_2$, $NJ_3$C(=X)$NJ_1J_2$, and CN, wherein X is O, S or $NJ_1$, and each $J_1$, $J_2$, and $J_3$ is, independently, H or $C_1$-$C_6$ alkyl.

In some embodiments, modified THP nucleosides are provided wherein $q_1$, $q_2$, $q_3$, $q_4$, $q_5$, $q_6$ and $q_7$ are each H. In some embodiments, at least one of $q_1$, $q_2$, $q_3$, $q_4$, $q_5$, $q_6$ and $q_7$ is other than H. In some embodiments, at least one of $q_1$, $q_2$, $q_3$, $q_4$, $q_5$, $q_6$ and $q_7$ is methyl. In some embodiments, modified THP nucleosides are provided wherein one of $R_1$ and $R_2$ is F. In some embodiments, $R_1$ is F and $R_2$ is H. In some embodiments, $R_1$ is methoxy and $R_2$ is H. In some embodiments, $R_1$ is methoxyethoxy and $R_2$ is H.

In some embodiments, sugar surrogates comprise rings having more than 5 atoms and more than one heteroatom. For example, nucleosides comprising morpholino sugar moieties and their use in polynucleotides have been reported (see, e.g., Braasch et al., Biochemistry, 2002, 41, 4503-4510 and Summerton et al., U.S. Pat. No. 5,698,685; Summerton et al., U.S. Pat. No. 5,166,315; Summerton et al., U.S. Pat. No. 5,185,444; and Summerton et al., U.S. Pat. No. 5,034, 506). As used here, the term "morpholino" means a sugar surrogate having the following structure:

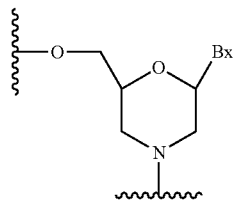

In some embodiments, morpholinos may be modified, for example by adding or altering various substituent groups from the above morpholino structure. Such sugar surrogates are referred to herein as "modified morpholinos."

In some embodiments, sugar surrogates comprise acyclic moieties. Examples of nucleosides and polynucleotides, e.g., polynucleotides, comprising such acyclic sugar surrogates include but are not limited to: peptide nucleic acid ("PNA"), acyclic butyl nucleic acid (see, e.g., Kumar et al., Org. Biomol. Chem., 2013, 11, 5853-5865), and nucleosides and polynucleotides described in Manoharan et al., WO2011/133876. Representative U.S. patents that teach the preparation of PNA compounds include, but are not limited to, U.S. Pat. Nos. 5,539,082; 5,714,331; and 5,719,262. Additional PNA compounds suitable herein are described in, for example, in Nielsen et al., Science, 1991, 254, 1497-1500.

In certain embodiments, sugar surrogates are the "unlocked" sugar structure of UNA (unlocked nucleic acid) nucleosides. UNA is an unlocked acyclic nucleic acid, wherein any of the bonds of the sugar has been removed, forming an unlocked sugar surrogate. Representative U.S. publications that teach the preparation of UNA include, but are not limited to, U.S. Pat. No. 8,314,227; and US Patent Publication Nos. 2013/0096289; 2013/0011922; and 2011/0313020, the entire contents of each of which are hereby incorporated herein by reference.

In certain embodiments, sugar surrogates are the glycerol as found in GNA (glycol nucleic acid) nucleosides as depicted below:

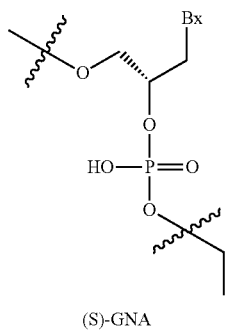

(S)-GNA where Bx represents any nucleobase.

Many other bicyclic and tricyclic sugar and sugar surrogate ring systems are known in the art that can be used in modified nucleosides.

Modified Nucleobases

In some embodiments, the polynucleotide comprises at least one modified nucleobase. In some embodiments, the at least one modified nucleobase is a 5-methylcytosine. In certain embodiments, polynucleotides comprise one or more inosine nucleosides (i.e., nucleosides comprising a hypoxantine nucleobase). Nucleobase (or base) modifications or substitutions are structurally distinguishable from, yet functionally interchangeable with, naturally occurring or synthetic unmodified nucleobases. Both natural and modified nucleobases are capable of participating in hydrogen bonding. Such nucleobase modifications can impart nuclease stability, binding affinity or some other beneficial biological property to antisense compounds.

In some embodiments, polynucleotides described herein comprise modifications, i.e., a modified polynucleotide. In some embodiments, modified polynucleotides comprise one or more nucleosides comprising an unmodified nucleobase. In some embodiments, modified polynucleotides comprise one or more nucleosides comprising a modified nucleobase. In some embodiments, modified polynucleotides comprise one or more nucleosides that does not comprise a nucleobase, referred to as an abasic nucleoside.

In some embodiments, the modified nucleobases are selected from 5-substituted pyrimidines, 6-azapyrimidines, alkyl or alkynyl substituted pyrimidines, alkyl substituted purines, and N-2, N-6 and 0-6 substituted purines. In some embodiments, the modified nucleobases are selected from 2-aminopropyladenine, 5-hydroxymethyl cytosine, 5-methylcytosine, xanthine, hypoxanthine, 2-aminoadenine, 6-N-methylguanine, 6-N-methyladenine, 2-propyladenine, 2-thiouracil, 2-thiothymine and 2-thiocytosine, 5-propynyl (C≡C—CH3) uracil, 5-propynylcytosine, 6-azouracil, 6-azocytosine, 6-azothymine, 5-ribosyluracil (pseudouracil), 4-thiouracil, 8-halo, 8-amino, 8-thiol, 8-thioalkyl, 8-hydroxyl, 8-aza and other 8-substituted purines, 5-halo, particularly 5-bromo, 5-trifluoromethyl, 5-halouracil, and 5-halocytosine, 7-methylguanine, 7-methyladenine, 2-F-adenine, 2-aminoadenine, 7-deazaguanine, 7-deazaadenine, 3-deazaguanine, 3-deazaadenine, 6-N-benzoyladenine, 2-N-isobutyrylguanine, 4-N-benzoylcytosine, 4-N-benzoyluracil, 5-methyl 4-N-benzoylcytosine, 5-methyl 4-N-benzoyluracil, universal bases, hydrophobic bases, promiscuous bases, size-expanded bases, and fluorinated bases. Further modified nucleobases include tricyclic pyrimidines, such as 1,3-diazaphenoxazine-2-one, 1,3-diazaphenothiazine-2-one and 9-(2-aminoethoxy)-1,3-diazaphenoxazine-2-one (G-clamp). Modified nucleobases may also include those in which the purine or pyrimidine base is replaced with other heterocycles, for example, 7-deaza-adenine, 7-deazaguanosine, 2-aminopyridine and 2-pyridone. Further nucleobases include those disclosed in Merigan et al., U.S. Pat. No. 3,687,808, those disclosed in The Concise Encyclopedia of Polymer Science and Engineering, Kroschwitz, J. I., Ed., John Wiley & Sons, 1990, 858-859; Englisch et al., Angewandte Chemie, International Edition, 1991, 30, 613; Sanghvi, Y. S., Chapter 15, Antisense Research and Applications, Crooke, S. T. and Lebleu, B., Eds., CRC Press, 1993, 273-288; and those disclosed in Chapters 6 and 15, Antisense Drug Technology, Crooke S. T., Ed., CRC Press, 2008, 163-166 and 442-443.

Publications describing the preparation of certain of the above noted modified nucleobases as well as other modified nucleobases include, without limitation, Manoharan et al., US2003/0158403, Manoharan et al., US2003/0175906; Dinh et al., U.S. Pat. No. 4,845,205; Spielvogel et al., U.S. Pat. No. 5,130,302; Rogers et al., U.S. Pat. No. 5,134,066; Bischofberger et al., U.S. Pat. No. 5,175,273; Urdea et al., U.S. Pat. No. 5,367,066; Benner et al., U.S. Pat. No. 5,432,272; Matteucci et al., U.S. Pat. No. 5,434,257; Gmeiner et al., U.S. Pat. No. 5,457,187; Cook et al., U.S. Pat. No. 5,459,255; Froehler et al., U.S. Pat. No. 5,484,908;

Matteucci et al., U.S. Pat. No. 5,502,177; Hawkins et al., U.S. Pat. No. 5,525,711; Haralambidis et al., U.S. Pat. No. 5,552,540; Cook et al., U.S. Pat. No. 5,587,469; Froehler et al., U.S. Pat. No. 5,594,121; Switzer et al., U.S. Pat. No. 5,596,091; Cook et al., U.S. Pat. No. 5,614,617; Froehler et al., U.S. Pat. No. 5,645,985; Cook et al., U.S. Pat. No. 5,681,941; Cook et al., U.S. Pat. No. 5,811,534; Cook et al., U.S. Pat. No. 5,750,692; Cook et al., U.S. Pat. No. 5,948,903; Cook et al., U.S. Pat. No. 5,587,470; Cook et al., U.S. Pat. No. 5,457,191; Matteucci et al., U.S. Pat. No. 5,763,588; Froehler et al., U.S. Pat. No. 5,830,653; Cook et al., U.S. Pat. No. 5,808,027; Cook et al., 6,166,199; and Matteucci et al., U.S. Pat. No. 6,005,096.

In some embodiments, polynucleotides targeted to a target nucleic acid, e.g., a sequence encoding PSD3 protein comprise one or more modified nucleobases. In some embodiments, the modified nucleobase of the polynucleotide is 5-methylcytosine. In some embodiments, each cytosine of the polynucleotide is a 5-methylcytosine.

Sugar Motifs

In some embodiments, polynucleotides provided herein comprise one or more types of modified sugar and/or unmodified sugar moiety arranged along the polynucleotide or region thereof in a defined pattern or sugar motif. In some embodiments, such sugar motifs include but are not limited to any of the sugar modifications discussed herein.

In some embodiments, modified polynucleotides comprise or consist of a region having a gapmer motif, which comprises two external regions or "wings" and a central or internal region or "gap." The three regions of a gapmer motif (the 5'-wing, the gap, and the 3'-wing) form a contiguous sequence of nucleosides wherein at least some of the sugar moieties of the nucleosides of each of the wings differ from at least some of the sugar moieties of the nucleosides of the gap. Specifically, at least the sugar moieties of the nucleosides of each wing that are closest to the gap (the 3'-most nucleoside of the 5'-wing and the 5'-most nucleoside of the 3'-wing) differ from the sugar moiety of the neighboring gap nucleosides, thus defining the boundary between the wings and the gap (i.e., the wing/gap junction). In some embodiments, the sugar moieties within the gap are the same as one another. In some embodiments, the gap includes one or more nucleoside having a sugar moiety that differs from the sugar moiety of one or more other nucleosides of the gap. In some embodiments, the sugar motifs of the two wings are the same as one another (symmetric gapmer). In some embodiments, the sugar motif of the 5'-wing differs from the sugar motif of the 3'-wing (asymmetric gapmer).

In some embodiments, the wings of a gapmer comprise 1-5 nucleosides. In some embodiments, the wings of a gapmer comprise 2-5 nucleosides. In some embodiments, the wings of a gapmer comprise 3-5 nucleosides. In some embodiments, the nucleosides of a gapmer are all modified nucleosides.

In some embodiments, the gap of a gapmer comprises 7-12 nucleosides. In some embodiments, the gap of a gapmer comprises 7-10 nucleosides. In some embodiments, the gap of a gapmer comprises 8-10 nucleosides. In some embodiments, the gap of a gapmer comprises 10 nucleosides. In certain embodiment, each nucleoside of the gap of a gapmer is an unmodified 2'-deoxy nucleoside.

In some embodiments, the gapmer is a deoxy gapmer. In such embodiments, the nucleosides on the gap side of each wing/gap junction are unmodified 2'-deoxy nucleosides and the nucleosides on the wing sides of each wing/gap junction are modified nucleosides. In some such embodiments, each nucleoside of the gap is an unmodified 2'-deoxy nucleoside. In some such embodiments, each nucleoside of each wing is a modified nucleoside.

In some embodiments, a modified polynucleotide has a fully modified sugar motif wherein each nucleoside of the modified polynucleotide comprises a modified sugar moiety. In some embodiments, a modified polynucleotide comprises or consists of a region having a fully modified sugar motif wherein each nucleoside of the region comprises a modified sugar moiety. In some embodiments, a modified polynucleotide comprises or consists of a region having a fully modified sugar motif, wherein each nucleoside within the fully modified region comprises the same modified sugar moiety, referred to herein as a uniformly modified sugar motif. In some embodiments, a fully modified polynucleotide is a uniformly modified polynucleotide. In some embodiments, each nucleoside of a uniformly modified polynucleotide comprises the same 2'-modification.

Nucleoside Motifs

Nucleobase (or base) modifications or substitutions are structurally distinguishable from, yet functionally interchangeable with, naturally occurring or synthetic unmodified nucleobases. Both natural and modified nucleobases are capable of participating in hydrogen bonding. Such nucleobase modifications can, for example, impart nuclease stability, binding affinity or some other beneficial biological property to polynucleotides provided herein, e.g., polynucleotides of the present disclosure.

In some embodiments, the polynucleotides provided herein comprise modified and/or unmodified nucleobases arranged along the polynucleotide or region thereof in a defined pattern or motif. In some embodiments, each nucleobase is modified. In some embodiments, none of the nucleobases are modified. In some embodiments, each purine or each pyrimidine is modified. In some embodiments, each adenine is modified. In some embodiments, each guanine is modified. In some embodiments, each thymine is modified. In some embodiments, each uracil is modified. In some embodiments, each cytosine is modified. In some embodiments, some or all of the cytosine nucleobases in a modified polynucleotide are 5-methylcytosines. In some embodiments, modified polynucleotides comprise a block of modified nucleobases. In some such embodiments, the block is at the 3'-end of the polynucleotide. In some embodiments, the block is within 3 nucleosides of the 3'-end of the polynucleotide. In some embodiments, the block is at the 5'-end of the polynucleotide. In some embodiments, the block is within 3 nucleosides of the 5'-end of the polynucleotide.

In some embodiments, polynucleotides having a gapmer motif comprise a nucleoside comprising a modified nucleobase. In some embodiments, one nucleoside comprising a modified nucleobase is in the central gap of a polynucleotide having a gapmer motif. In some embodiments, the sugar moiety of said nucleoside is a 2'-deoxyribosyl moiety. In some embodiments, the modified nucleobase is selected from: a 2-thiopyrimidine and a 5-propynepyrimidine.

In some embodiments, polynucleotides provided herein comprise modified and/or unmodified internucleoside linkages arranged along the polynucleotide or region thereof in a defined pattern or motif. In some embodiments, each internucleoside linking group is essentially a phosphate internucleoside linkage (P=O). In some embodiments, each internucleoside linking group of a modified polynucleotide is a phosphorothioate (P=S). In some embodiments, each internucleoside linking group of a modified polynucleotide is independently selected from a phosphorothioate and phosphate internucleoside linkage. In some embodiments, the sugar motif of a modified polynucleotide is a gapmer and the internucleoside linkages within the gap are all modified. In some such embodiments, some or all of the internucleoside linkages in the wings are unmodified phosphate linkages. In some embodiments, the terminal internucleoside linkages are modified.

Modified Polynucleotides

In some embodiments, one or more of the above modifications (e.g., sugar, nucleobase, internucleoside linkage) are incorporated into a modified polynucleotide. In some embodiments, the modified polynucleotide is characterized by its modification, motifs, and overall length. In some embodiments, such parameters are each independent of one another. Thus, unless otherwise indicated, each internucleoside linkage of a polynucleotide having a gapmer sugar motif may be modified or unmodified and may or may not follow the gapmer modification pattern of the sugar modifications. For example, the internucleoside linkages within the wing regions of a sugar gapmer may be the same or different from one another and may be the same or different from the internucleoside linkages of the gap region of the sugar motif. Likewise, such gapmer polynucleotides may comprise one or more modified nucleobase independent of the gapmer pattern of the sugar modifications. Furthermore, in certain instances, a polynucleotide is described by an overall length or range and by lengths or length ranges of two or more regions (e.g., a region of nucleosides having specified sugar modifications). In such embodiments, it may be possible to select numbers for each range that result in a polynucleotide having an overall length falling outside the specified range. In such embodiments, both elements must be satisfied. For example, in some embodiments, a modified polynucleotide consists of 15-20 linked nucleosides and has a sugar motif consisting of three regions, A, B, and C, wherein region A consists of 2-6 linked nucleosides having a specified sugar motif, region B consists of 6-10 linked nucleosides having a specified sugar motif, and region C consists of 2-6 linked nucleosides having a specified sugar motif.

In some embodiments, the compounds provided herein comprise or consist of a polynucleotide (modified or unmodified) and optionally one or more conjugate groups and/or terminal groups. Conjugate groups consist of one or more conjugate moiety and a conjugate linker which links the conjugate moiety to the polynucleotide. Conjugate groups may be attached to either or both ends of a polynucleotide and/or at any internal position. In some embodiments, conjugate groups are attached to the 2'-position of a nucleoside of a modified polynucleotide. In some embodiments, conjugate groups that are attached to either or both ends of a polynucleotide are terminal groups. In certain such embodiments, conjugate groups or terminal groups are attached at the 3' and/or 5'-end of a polynucleotide. In certain such embodiments, conjugate groups (or terminal groups) are attached at the 3'-end of a polynucleotide. In some embodiments, conjugate groups are attached near the 3'-end of a polynucleotide. In some embodiments, conjugate groups (or terminal groups) are attached at the 5'-end of a polynucleotide. In some embodiments, conjugate groups are attached near the 5'-end of a polynucleotide.

In some embodiments, the conjugate/terminal group of a polynucleotide comprises a capping group, a phosphate moiety, a protecting group, and a modified or unmodified nucleoside. In some embodiments, the conjugate/terminal group includes an intercalator, a reporter, a polyamine, a polyamide, a peptide, a carbohydrate (e.g., GalNAc), a vitamin, a polyethylene glycol, a thioether, a polyether, a folate, a lipid, a phospholipid, biotin, phenazine, phenanthridine, anthraquinone, adamantane, acridine, fluorescein, rhodamine, coumarin, a fluorophore, and a dye.

In some embodiments, the conjugate/terminal group of a polynucleotide comprises a targeting moiety. In some embodiments, the targeting moiety is at the 5' end of the polynucleotide. In some embodiments, the targeting moiety is at the 3' end of the polynucleotide. In some embodiments, the targeting moiety targets the polynucleotide to a specific subcellular location and/or a specific cell or tissue type. In some embodiments, the targeting moiety comprises a ligand for a receptor. In some embodiments, the receptor is specific to a type of cell and/or tissue. In some embodiments, recognition of the targeting moiety (e.g., ligand) by the receptor mediates endocytosis of the polynucleotide conjugated to the targeting moiety.

In some embodiments, the targeting moiety targets a liver cell (also referred to herein as a hepatocyte). In some embodiments, the liver cell is a human liver cell. In some embodiments, the liver cell expresses an asialoglycoprotein receptor (ASGPr) on its cell surface. In some embodiments, the targeting moiety is a ligand for the ASGPr. In some embodiments, the targeting moiety comprises an N-acetylgalactosamine (GalNAc) moiety. In some embodiments, the targeting moiety comprises 1 to 5 GalNAc moieties. In some embodiments, the targeting moiety comprises 1, 2, 3, 4, or 5 GalNAc moieties. In some embodiments, the targeting moiety comprises 3 GalNAc moieties. In some embodiments, the targeting moiety comprises 3 GalNAc moieties in a triantennary arrangement (a triantennary GalNAc). In some embodiments, the polynucleotide comprises a triantennary GalNAc at the 5' of the polynucleotide.

In certain embodiments, polynucleotides comprise a stabilized phosphate group at the 5'-end. In certain such embodiments, the compound is a ssRNAi compound or the compound is an siRNA and the polynucleotide comprising a stabilized phosphate group is the antisense strand of the siRNA compound. The 5'-end phosphorus-containing group can be 5'-end phosphate (5'-P), 5'-end phosphorothioate (5'-PS), 5'-end phosphorodithioate (5'-PS$_2$), 5'-end vinylphosphonate (5'-VP), 5'-end methylphosphonate (MePhos) or 5'-deoxy-5'-C-malonyl. When the 5'-end phosphorus-containing group is 5'-end vinylphosphonate, the 5'VP can be either 5'-E-VP isomer (i.e., trans-vinylphosphate), 5'-Z-VP isomer (i.e., cis-vinylphosphate), or mixtures thereof. Although such phosphate group can be attached to either the antisense RNAi polynucleotide or the antisense RNAi polynucleotide, it will typically be attached to the antisense RNAi polynucleotide as that has been shown to improve activity of certain RNAi compounds. See, e.g., Prakash et al., Nucleic Acids Res., 43(6):2993-3011, 2015; Elkayam, et al., Nucleic Acids Res., 45(6):3528-3536, 2017; Parmar, et al. ChemBioChem, 17(11)985-989; 2016; Harastzi, et al., Nucleic Acids Res., 45(13):7581-7592, 2017. In certain embodiments, the phosphate stabilizing group is 5'-cyclopropyl phosphonate. See e.g., WO/2018/027106.

In certain embodiments, a polynucleotide is complementary to the target nucleic acid over the entire length of the polynucleotide. In certain embodiments, polynucleotides are 99%, 95%, 90%, 85%, or 80% complementary to the target nucleic acid. In certain embodiments, polynucleotides are at least 80% complementary to the target nucleic acid over the entire length of the polynucleotide and comprise a region that is 100% or fully complementary to a target nucleic acid.

In certain embodiments, the region of full complementarity is from 6 to 20, 10 to 18, or 18 to 20 nucleobases in length.

In certain embodiments, polynucleotides comprise a targeting region complementary to the target nucleic acid. In certain embodiments, the targeting region comprises or consists of at least 8, at least 9, at least 10, at least 11, at least 12, at least 13, at least 14, at least 15, at least 16, at least 17, at least 18, at least 19, at least 20, at least 21, at least 22, at least 23, at least 25 or at least 25 contiguous nucleotides. In certain embodiments, the targeting region constitutes 70%, 80%, 85%, 90%, 95% of the nucleosides of the polynucleotide. In certain embodiments, the targeting region constitutes all of the nucleosides of the polynucleotide. In certain embodiments, the targeting region of the polynucleotide is at least 99%, 95%, 90%, 85%, or 80% complementary to the target nucleic acid. In certain embodiments, the targeting region of the polynucleotide is 100% complementary to the target nucleic acid In certain embodiments, RNAi compounds comprise a sense RNAi polynucleotide. In such embodiments, sense RNAi polynucleotide comprise an antisense hybridizing region complementary to the antisense RNAi polynucleotide. In certain embodiments, the antisense hybridizing region comprises or consists of at least 8, at least 9, at least 10, at least 11, at least 12, at least 13, at least 14, at least 15, at least 16, at least 17, at least 18, at least 19, at least 20, at least 21, at least 22, at least 23, at least 25 or at least 25 contiguous nucleotides. In certain embodiments, the antisense hybridizing region constitutes 70%, 80%, 85%, 90%, 95% of the nucleosides of the sense RNAi polynucleotide. In certain embodiments, the antisense hybridizing region constitutes all of the nucleosides of the sense RNAi polynucleotide. In certain embodiments, the antisense hybridizing region of the sense RNAi polynucleotide is at least 99%, 95%, 90%, 85%, or 80% complementary to the antisense RNAi polynucleotide. In certain embodiments, the antisense hybridizing region of the sense RNAi oligonucleotide is 100% complementary to the antisense RNAi polynucleotide.

The hybridizing region of a sense RNAi polynucleotide hybridizes with the antisense RNAi polynucleotide to form a duplex region. In certain embodiments, such duplex region consists of 7 hybridized pairs of nucleosides (one of each pair being on the antisense RNAi polynucleotide and the other of each pair being on the sense RNAi polynucleotide). In certain embodiments, a duplex region comprises least 8, at least 9, at least 10, at least 11, at least 12, at least 13, at least 14, at least 15, at least 16, at least 17, at least 18, at least 19, at least 20, at least 21, at least 22, at least 23, at least 25 or at least 25 hybridized pairs. In certain embodiments, each nucleoside of antisense RNAi polynucleotide is paired in the duplex region (i.e., the antisense RNAi polynucleotide has no overhanging nucleosides). In certain embodiments, the antisense RNAi polynucleotide includes unpaired nucleosides at the 3'-end and/or the 5'end (overhanging nucleosides). In certain embodiments, each nucleoside of sense RNAi polynucleotide is paired in the duplex region (i.e., the sense RNAi polynucleotide has no overhanging nucleosides). In certain embodiments, the sense RNAi polynucleotide includes unpaired nucleosides at the 3'-end and/or the 5'end (overhanging nucleosides). In certain embodiments, duplexes formed by the antisense RNAi polynucleotide and the sense RNAi polynucleotide do not include any overhangs at one or both ends. Such ends without overhangs are referred to as blunt. In certain embodiments wherein the antisense RNAi polynucleotide has overhanging nucleosides, one or more of those overhanging nucleosides are complementary to the target nucleic acid. In certain embodiments wherein the antisense RNAi polynucleotide has overhanging nucleosides, one or more of those overhanging nucleosides are not complementary to the target nucleic acid.

Additional Compounds

In some embodiments, the compound of the present disclosure for treating or preventing fatty liver disease in a subject in need thereof or for lowering of PSD3 expression comprises an siRNA. A "short-interfering RNA," "small-interfering RNA," "silencing RNA," or "siRNA," is a class of compound comprising complementary RNA polynucleotides hybridized to one another, each comprising about 15 to about 30 linked nucleosides. siRNA operates in vivo within the RNA interference (RNAi) pathway and acts, at least in part, through RISC or Ago2 to interfere with expression of specific genes with complementary nucleotide sequences by degrading mRNA after transcription, thereby preventing translation. See, e.g., Dana et al., Int J Biomed Sci 13(2), 48-57 (2017), Whitehead et al., Ann Rev Chem Biomol Eng 2, 77-96 (2011), Filipowicz et al., Curr Opin Struct Biol 15, 331-341, (2005)

In some embodiments, the compound is an siRNA capable of hybridizing with a nucleic acid encoding the PSD3 protein and capable of inhibiting expression of the PSD3 protein. In some embodiments, the siRNA comprises a nucleotide sequence at least 50%, at least 55%, at least 60%, at least 65%, at least 70%, at least 75%, at least 80%, at least 85%, at least 90%, at least 95%, or about 100% complementary to an equal length portion of a nucleic acid sequence encoding the PSD3 protein. In some embodiments, the siRNA comprises a nucleotide sequence at least 90%, at least 91%, at least 92%, at least 93%, at least 94%, at least 95%, at least 96%, at least 97%, at least 98%, at least 99%, or about 100% complementary to an equal length portion of a sequence encoding the PSD3 protein. In some embodiments, the siRNA comprises a nucleotide sequence at least at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or about 100% complementary to an equal length portion of any one of SEQ ID NOs: 2-18.

In some embodiments, the compound of the present disclosure for treating or preventing fatty liver disease in a subject in need thereof or for lowering of PSD3 expression comprises a miRNA. A "microRNA" or "miRNA" is a single-stranded RNA polynucleotide of about 15 to about 30 nucleotides in length that functions in vivo in RNA silencing and post-transcriptional regulation of gene expression. miRNA functions via base-pairing with complementary sequences with mRNA. As a result of the miRNA base-pairing, the mRNA is "silenced" by one or more of the following processes: (1) cleavage of the mRNA strand into two pieces; (2) destabilization of the mRNA through shortening of its poly(A) tail; and (3) less efficient translation of the mRNA. miRNAs are similar to siRNAs described herein, except that miRNA generally derive from regions of RNA that fold back on themselves to form hairpin structures, whereas siRNA derive from longer regions of double-stranded RNA. See, e.g., Filipowicz et al., Curr Opin Struct Biol 15, 331-341, (2005), van Rooij et al., J Clin Invest 117, 2369-2376 (2007), and MacFarlane et al., Curr Genomics 11(7), 537-561 (2010).

In some embodiments, the compound is a miRNA capable of hybridizing with a nucleic acid encoding the PSD3 protein and capable of inhibiting expression of the PSD3 protein. In some embodiments, the miRNA comprises a nucleotide sequence at least 50%, at least 55%, at least 60%, at least 65%, at least 70%, at least 75%, at least 80%, at least 85%, at least 90%, at least 95%, or about 100% complementary to an equal length portion of a nucleic acid sequence encoding the PSD3 protein. In some embodiments, the miRNA comprises a nucleotide sequence at least 90%, at least 91%, at least 92%, at least 93%, at least 94%, at least 95%, at least 96%, at least 97%, at least 98%, at least 99%, or about 100% complementary to an equal length portion of a sequence encoding the PSD3 protein. In some embodiments, the miRNA comprises a nucleotide sequence at least at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or about 100% complementary to an equal length portion of any one of SEQ ID NOs: 2-18.

Cells and Subjects

In some embodiments, the compound of the present disclosure is administered to a subject. In some embodiments, the compound of the present disclosure is administered to a cell and/or a tissue. In some embodiments, the compound is administered to a cell and/or tissue in vitro, e.g., in a cell or tissue culture plate. In some embodiments, the cell is a liver cell, i.e., a hepatocyte. In some embodiments, the cell is a human hepatocyte, an animal hepatocyte, or a non-parenchymal cell.

In some embodiments, the compound is administered to a cell and/or tissue in vivo, e.g., in a subject. In some embodiments, the subject is a human subject. In some embodiments, the subject is an animal subject. In some embodiments, the animal is an animal model, e.g., a disease model. For example, the subject can be a human, a rat, a dog, a mouse, a monkey, a cat, or a rabbit.

Diseases and Conditions

In some embodiments, the subject is at risk of, or has, fatty liver disease. NAFLD is defined as fat accumulation in the liver exceeding 5% by weight, in the absence of significant alcohol consumption, steatogenic medication, or hereditary disorders (Kotronen et al, Arterioscler Thromb. Vasc. Biol. 2008, 28: 27-38). NAFLD covers a spectrum of liver disease from steatosis to nonalcoholic steatohepatitis (NASH) and cirrhosis. Non-alcoholic steatohepatitis (NASH) is NAFLD with signs of inflammation and hepatic injury. NASH is defined histologically by macrovesicular steatosis, hepatocellular ballooning, and lobular inflammatory infiltrates (Sanyal, Hepatol. Res. 2011. 41: 670-4). NASH is estimated to affect 2-3% of the general population. In the presence of other pathologies, such as obesity or diabetes, the estimated prevalence increases to 7% and 62% respectively (Hashimoto et al, J. Gastroenterol. 2011. 46(1): 63-69).

Fatty liver disease can include an increase in one or more of intracellular fat content, liver weight, liver triglyceride content, plasma circulating alanine aminotransferase (ALT), liver collagen 1a1, and lipid content. Treatment of fatty liver disease may be further complicated due to fatty liver disease drugs, e.g., anti-NASH drugs, in clinical development causing increase in cholesterol, in particular LDL cholesterol, which is a known risk factor for cardiovascular disease.

In some embodiments, the present disclosure provides a method of treating or preventing fatty liver disease in a subject in need thereof, the method comprising administering a compound comprising a polynucleotide effective for lowering the expression of PSD3 in the subject, e.g., a polynucleotide provided herein. In some embodiments, the subject of the present disclosure in need of treatment or prevention of fatty liver disease has one or more of non-alcoholic fatty liver disease (NAFLD), non-alcoholic steatohepatitis (NASH) (cirrhotic and non-cirrhotic NASH), hepatocellular carcinoma (HCC) and/or liver fibrosis. In some embodiments, the subject of the present disclosure in need of treatment or prevention of fatty liver disease has alcoholic fatty liver disease (AFLD) or alcoholic steatohepatitis (ASH) (cirrhotic and non-cirrhotic ASH). In some embodiments, the subject of the present disclosure in need of treatment or prevention of fatty liver disease has liver damage, steatosis, liver fibrosis, liver inflammation, liver scarring or cirrhosis, liver failure in the subject.

In some embodiments, the method decreases one or more of intracellular fat content, liver weight, liver triglyceride content, plasma circulating alanine aminotransferase (ALT), liver collagen 1a1, and lipid content in the subject. In some embodiments, the amount of cholesterol and/or LDL of the subject decreases following administration of the compound. In some embodiments, the subject of the present disclosure in need of treatment or prevention of fatty liver disease has a cardiovascular disease such as dyslipidemia. In certain embodiments, the disease is mixed dyslipidemia. In certain embodiments, the disease is hypercholesterolemia. In certain embodiments, the disease is familial hypercholesterolemia.

In some embodiments, the present disclosure provides a method of lowering intracellular fat content in a liver cell in a subject, the method comprising administering a compound comprising a polynucleotide effective for lowering the expression of PSD3 in the subject. In some embodiments, the compound is a polynucleotide provided herein.

In some embodiments, the present disclosure provides a method of lowering cholesterol in a subject, the method comprising administering a compound comprising a polynucleotide effective for lowering the expression of PSD3 in the subject. In some embodiments, the compound is a polynucleotide provided herein.

Without being bound by any particular theory, the correlation between PSD3 and fatty liver disease may be related to PSD3 activation of ADP-ribosylation factor 6 (ARF6). PSD3 is believed to interact with and activate ARF6 by catalyzing the conversion of ARF6-GDP to ARF-GTP. ARF6 is involved in intracellular vesicle trafficking and shares homology with ARF1, which is involved in lipid droplet formation, and thus, ARF6 may be contributing to liver fat content by affecting lipid droplet trafficking and formation. Accordingly, in some embodiments, the present disclosure provides a method of reducing activation of ADP-ribosylation factor 6 (ARF6), the method comprising lowering of PSD3 expression in a subject, comprising administering a compound comprising a polynucleotide effective for lowering the expression of PSD3 in the subject, wherein lower PSD3 expression provides for reduced activation of ARF6.

Identification and Treatment of a Subpopulation

In some embodiments, the subject of the present disclosure to be treated for fatty liver disease does not have a 186T allelic variant of the PSD3 protein. As described herein, PSD3 was discovered as a potential target for treatment or prevention of fatty liver disease due to the novel identification of a PSD3 L186T variant in certain individuals that resulted in lower incidence of fatty liver disease and lower cholesterol and LDL cholesterol levels. Results described herein demonstrate that this genetic variant is a loss of function mutation which reduces the guanine-exchange activity of PSD3 protein. Results described herein also demonstrate that the presence of the 186L allele drives liver disease. Thus, the data described herein suggest that PSD3 downregulation may confer protection against NAFLD.

The PSD3 allelic variants (i.e., 186T and 186L) may provide a useful way to distinguish a subpopulation of subjects having fatty liver disease suitable for PSD3 reduction therapy. In some embodiments, the present disclosure provides a method of identifying a subpopulation of subjects having fatty liver disease suitable for PSD3 reduction therapy, the method comprising: (a) diagnosing whether the subject has fatty liver disease; and (b) determining whether the subject has the 186T allelic variant of PSD3 protein or the 186L allelic variant of PSD3 protein; wherein if the subject has the 186L allelic variant of PSD3 protein, then a suitable treatment comprises administering a compound comprising a polynucleotide effective for lowering the expression of PSD3; and wherein if the subject has the 186T allelic variant of PSD3, then treatment does not comprise administering a compound comprising a polynucleotide effective for lowering the expression of PSD3 is not suitable. In some embodiments, step (b) may be determined by genotyping the 186L allelic variant or by inference from genotyping a genetic variant in strong linkage disequilibrium with the 186L allelic variant.

In some embodiments, the present disclosure further provides a method of treating a subject having fatty liver disease, the method comprising: (a) determining whether the subject has the 186T allelic variant of PSD3 protein or the 186L allelic variant of PSD3 protein; and (b) administering a compound comprising a polynucleotide effective for lowering the expression of PSD3 only if the subject has the 186L allelic variant of PSD3. In some embodiments, step (a) may be determined by genotyping the 186L allelic variant or by inference from genotyping a genetic variant in strong linkage disequilibrium with the 186L allelic variant.

Prevention

In some embodiments, the disclosure provides methods of preventing fatty liver disease in a subject in need thereof, comprising administering a compound comprising a polynucleotide effective for lowering the expression of Pleckstrin and Sec7 Domain Containing 3 (PSD3) in the subject. The term "preventing" or "prevent" as used herein is to statistically improve the likelihood that a subject who has a higher risk of developing fatty liver disease. Thus, administering the compound effective for lowering PSD3 expression can be provided to the subject before the onset of fatty liver disease. In some embodiments, the subject at higher risk of developing fatty liver disease has the 186L allelic variant of PSD3 protein. Thus, in some embodiments, the disclosure is directed to preventing fatty liver disease in a subject having the 186L allelic variant of PSD3, comprising administering a compound comprising a polynucleotide effective for lowering PSD3 expression to the subject.

All references cited herein, including patents, patent applications, papers, textbooks and the like, and the references cited therein, to the extent that they are not already, are hereby incorporated herein by reference in their entirety.

NONLIMITING DISCLOSURE AND INCORPORATION BY REFERENCE

While certain compounds, compositions and methods described herein have been described with specificity in accordance with certain embodiments, the following examples serve only to illustrate the compounds described herein and are not intended to limit the same. Each of the references, GenBank accession numbers, and the like recited in the present application is incorporated herein by reference in its entirety.

Although the sequence listing accompanying this filing identifies each sequence as either "RNA" or "DNA" as required, in reality, those sequences may be modified with any combination of chemical modifications. One of skill in the art will readily appreciate that such designation as "RNA" or "DNA" to describe modified oligonucleotides is, in certain instances, arbitrary. For example, a polynucleotide comprising a nucleoside comprising a 2'-OH sugar moiety and a thymine base could be described as a DNA having a modified sugar (2'-OH in place of one 2'-H of DNA) or as an RNA having a modified base (thymine (methylated uracil) in place of an uracil of RNA). Accordingly, nucleic acid sequences provided herein, including, but not limited to those in the sequence listing, are intended to encompass nucleic acids containing any combination of natural or modified RNA and/or DNA, including, but not limited to such nucleic acids having modified nucleobases. By way of further example and without limitation, a polynucleotide having the nucleobase sequence "ATCGATCG" encompasses any compounds having such nucleobase sequence, whether modified or unmodified, including, but not limited to, such compounds comprising RNA bases, such as those having sequence "AUCGAUCG" and those having some DNA bases and some RNA bases such as "AUCGATCG" and compounds having other modified nucleobases, such as "AT$^m$CGAUCG," wherein $^m$C indicates a cytosine base comprising a methyl group at the 5-position.

Certain compounds described herein (e.g., modified oligonucleotides) have one or more asymmetric center and thus give rise to enantiomers, diastereomers, and other stereoisomeric configurations that may be defined, in terms of absolute stereochemistry, as (R) or (S), as α or β such as for sugar anomers, or as (D) or (L), such as for amino acids, etc. Compounds provided herein that are drawn or described as having certain stereoisomeric configurations include only the indicated compounds. Compounds provided herein that are drawn or described with undefined stereochemistry include all such possible isomers, including their stereorandom and optically pure forms, unless specified otherwise. Likewise, tautomeric forms of the compounds herein are also included unless otherwise indicated. Unless otherwise indicated, compounds described herein are intended to include corresponding salt forms.

The compounds described herein include variations in which one or more atoms are replaced with a non-radioactive isotope or radioactive isotope of the indicated element. For example, compounds herein that comprise hydrogen atoms encompass all possible deuterium substitutions for each of the $^1$H hydrogen atoms. Isotopic substitutions encompassed by the compounds herein include but are not limited to: $^2$H or $^3$H in place of $^1$H, $^{13}$C or $^{14}$C in place of $^{12}$C, $^{15}$N in place of $^{14}$N, $^{17}$O or $^{18}$O in place of $^{16}$O, and $^{33}$S, $^{34}$S, $^{35}$S, or $^{36}$S in place of $^{32}$S. In certain embodiments, non-radioactive isotopic substitutions may impart new properties on the oligomeric compound that are beneficial for use as a therapeutic or research tool. In certain embodiments, radioactive isotopic substitutions may make the compound suitable for research or diagnostic purposes such as imaging.

EXAMPLES

Example 1—PSD3 Sequence Variation and Association with FLD

In the discovery phase, 32 genetic tagging single nucleotide polymorphisms (SNPs) previously associated with triglycerides as main (n=24) or secondary trait (n=8) at a genome-wide significant level were selected (Teslovich et al., Nature 466, 707-713, 2010) (FIG. 1). Then, all missense and non-sense variants within 50 kb of the selected loci that were on the Illumina HumanExome Bead chip (including the tagging SNPs when available) were tested for association with liver fat content in the Dallas Heart Study (DHS) (FIG. 2). When the tagging SNP was intergenic, variants on both genes adjacent to the tagging SNP were analyzed.

Study Cohorts

Dallas Heart Study (DHS)—The Dallas Heart Study (DHS) is a multi-ethnic population-based sample of Dallas County residents. The study design and recruitment procedures have been previously described in Victor, R. G., et al. The Dallas Heart Study: a population-based probability sample for the multidisciplinary study of ethnic differences in cardiovascular health (Am J Cardiol 93, 1473-1480 (2004)). Briefly, the original cohort was enrolled between 2000 and 2002, and all the participants as well as their spouses or significant others were invited for a repeat evaluation in 2007-2009 (DHS-2). At the time of enrolment, all participants completed a detailed survey, and underwent clinical examination that involved measurement of blood pressure, anthropometry, blood and urine sample collection, and imaging studies. Ethnicity was self-reported. Hepatic triglyceride content was measured with proton magnetic resonance spectroscopy (1H-MRS) in n=2736 participants as previously described in Browning, J. D., et al., Hepatology 40, 1387-1395 (2004) and Szczepaniak, L. S., et al., Am J Physiol 276, E977-989 (1999). For the present study, all analyses were based on cross-sectional data. Given the low prevalence of heavy drinking (>30 g/day), subjects were not excluded based on alcohol intake. The study was approved by the Institutional Review Board of University of Texas Southwestern Medical Center and all individuals provided written informed consent.

Liver Biopsy Cohort (LBC)—The liver biopsy cohort (LBC) is a cross sectional study of individuals of European descent who underwent liver biopsy for suspected NASH or severe obesity and have been consecutively enrolled in three European centers. The study has been previously described in Dongiovanni, P., et al., Hepatology 61, 506-514 (2015) and Mancina, R. M., et al., Gastroenterology (2016). In the present study, only individuals with complete data available for both PSD3 genotype and liver histology were included. To these, a total of 323 individuals from a forth and independent Finnish center has been included. In the present study, 1951 individuals from 4 different European centers have been included: 1,022 (52%) were from Milan (the Metabolic Liver Diseases outpatient service and from the Fondazione IRCCS Ca' Granda Ospedale Policlinico Milano, Milan, Italy) (see Valenti, L., et al., J Hepatol 55, 1409-1414 (2011)), 374 (19%) were from the Gastrointestinal & Liver Unit of the Palermo University Hospital, Palermo, Italy (see Petta, S., et al., PLoS One 9, e87523 (2014)), 410 (21%) were from the Northern Savo Hospital District, Kuopio, Finland (see Simonen, M., et al., Hepatology 58, 976-982 (2013)), and 145 (7%) were from the Hospital District of Helsinki and Uusimaa, Finland (see Simonen, M. et al., J Hepatol 64, 1167-1175 (2016)). Individuals with increased alcohol intake (men, >30 g/day; women, >20 g/day), viral and autoimmune hepatitis or other causes of liver disease were excluded. Diagnosis of NASH was based on the presence of steatosis with lobular necro-inflammation and ballooning or fibrosis. Disease activity was assessed according to the NAFLD Activity Score (NAS); fibrosis was staged according to the recommendations of the NAFLD clinical research network as described in Kleiner, D. E., et al. Design and validation of a histological scoring system for nonalcoholic fatty liver disease. Hepatology 41, 1313-1321 (2005). The scoring of liver biopsies was performed by independent pathologists unaware of patients' status and genotype. The study was approved by the Ethics Committees of the Fondazione IRCCS Ca' Granda (Milan), Palermo University Hospital (Palermo), and Northern Savo Hospital District in Kuopio (Finland), and the ethics committee of the Hospital District of Helsinki and Uusimaa (Finland).

UK Biobank Cohort—The UK Biobank is a large cohort study comprising more than 500,000 adult individuals (aged between 40-69 years at recruitment) who visited 22 recruitment centers throughout the UK between 2006 and 2014. Both the phenotypic and genotypic data used in the present study were obtained from the UK Biobank under Application Number 37142. Analysis was restricted to a subset of UK Biobank participants with European ancestry (defined by self-reporting as 'British', 'Irish' or 'White', after removal of outliers based on the first 2 genetic principal components). Individuals were excluded that had (1) excessive relatives (more than 10 putative third-degree relatives); (2) a mismatch between the self-reported and genetically inferred gender; or (3) putative sex chromosome aneuploidy and those who were (4) identified by the UK Biobank as outliers based on heterozygosity and missingness Canela-Xandri et al (Nature genetics 50, 1593-1599 (2018)) and Crawford et al (J. Med. Genet. 56, 131-138 (2019)). UK Biobank participants were genotyped using two highly similar UK BiLEVE or UK Biobank Axiom arrays (>95% overlap). Genotyped data were then imputed based on the 1000 Genomes Phase 3, UK10K haplotype, and Haplotype Reference Consortium (HRC) reference panels (see C. Bycroft et al., The UK Biobank resource with deep phenotyping and genomic data. Nature 562, 203-209 (2018)). Genotype data for the rs71519934 dinucleotide change were not available in the UK Biobank; the rs7003060 (identifying the first nucleotide change of the rs71519934) was among directly genotyped variants and was used instead. Liver magnetic resonance imaging (MRI) derived proton density fat fraction (PDFF) data (data-field 22436) was used and participants were scanned with a Siemens MAGNETOM Aera 1.5-T MRI scanner using a 6-minute dual-echo Dixon Vibe protocol, and a single multi-echo slice was further acquired to analyse the liver PDFF. The UK Biobank study received ethical approval from the National Research Ethics Service Committee North West Multi-Centre Haydock (reference 16/NW/0274).

Independent Replication EU Cohort—In total, 674 adult Caucasian NAFLD individuals (mean age 45±12 years) with BMI>30 $Kg/m^2$ from tertiary referral centers in Austria (n=83), Germany (n=559) and Switzerland (n=32) who underwent percutaneous or surgical liver biopsy were included (see V. R. Thangapandi et al., Gut, (2020)). NASH was defined by the NAFLD activity score (NAS). The presence of fibrosis was assessed histologically according to Kleiner classification (D. E. Kleiner et al., Hepatology 41, 1313-1321 (2005)). In all patients infectious (e.g. viral hepatitis, HIV), immunological, drug-induced hepatic steatosis (e.g. amiodarone, methotrexate, steroids, valproate, etc.) or hereditary causes (hereditary hemochromatosis, Wilson disease) of chronic liver disease were excluded by accepted measures. As assessed by self-reporting, subjects with average alcohol consumption of more than 30 g/day (in men) or 20 g/day (in women) were not included. Liver biopsies were read by 2 experienced histopathologists in a blinded fashion. All patients gave their written informed consent for liver biopsy and genetic testing.

Statistical analysis—For the DHS, the P-values for associations between liver fat content and the target variants were calculated using linear regression analysis adjusted for age, gender, and the 4 leading principal components of ancestry. An additive genetic model was used in all analyses. For the LBC and for the Independent Replication EU Cohort, the association between the PSD3 rs71519934 variant and liver disease was evaluated under an additive genetic model by binary logistic (prevalence of liver disease) or ordinal regression (liver histological features) analysis adjusted for age, gender, body mass index (BMI), centre of recruitment and number of PNPLA3 I148M mutant alleles. For the UK Biobank, liver PDFF was first rank-based inverse normal transformed, and then the associations with PSD3 rs7003060 was examined using linear regression adjusted for age, gender, BMI, the first ten genomic principal components, and array type under an additive genetic model. For descriptive statistics, data are shown as the means and standard deviations or the medians and quartile range as appropriate. Categorical traits are shown as numbers and proportions. For continuous traits, P-values were calculated by linear regression under an additive genetic model unadjusted or adjusted for age, gender and BMI. Non-normally distributed traits were log transformed before being entered into the model. For categorical traits, P-values were calculated by the chi-squared test or by binary logistic regression adjusted for age, gender and BMI. Differences in expression levels in human tissues were evaluated by the Mann-Whitney non-parametric test (for comparisons between healthy individuals vs those with FLD) or by linear regression analysis (for comparisons among genotypes). For the meta-analyses of the histological cohorts an inverse variance meta-analysis of the two studies (liver biopsy cohort and central European replication cohort) was performed using package "meta" with fixed- and random-effect models in R version 3.6.1. For in vivo and in vitro studies, data are shown as the means and standard deviations. P-values were calculated by the Mann-Whitney non-parametric test (in vitro) or one-way ANOVA Kruskal-Wallis non-parametric test with Dunn's correction for multiple comparisons (in vivo).

Genotyping and Validation

Genotyping—All participants from the DHS were previously genotyped for the variants using an Illumina Infinium HumanExome BeadChip as described in J. Kozlitina et al., Nature genetics 46, 352-356 (2014) and S. Romeo et al., Nature genetics 40, 1461-1465 (2008). Participants from the LBC and from the Independent Replication EU Cohort were genotyped by TaqMan 5' nuclease assays (Life Technologies, Carlsbad, CA). The allelic discrimination probe for PSD3 rs71519934 was not commercially available. A custom assay for this variant has been designed as follows:

Context Sequence:
(SEQ ID NO: 21)
CGTTGTTACTTCAGCTGAAAGAGGTATTTCNGGTAAATTTTTTGGCCAG

CAGGGAGC[GT/AG]TTTGTTGACTCTCTGTGTTTTACNNCTGGCAGTGT

CCANCTCTTTTTCCACCTGCTGANCTGAAAAACTAGAAACAGCATCTTGG

TCCA;

forward primer:
(SEQ ID NO: 22)
CGTTGTTACTTCAGCTGAAAGAGGTA;

reverse primer:
(SEQ ID NO: 23)
TGGACCAAGATGCTGTTTCTAGTTT;

Reporter 1 (VIC) Sequence:
(SEQ ID NO: 24)
TCAACAAAACGCTCCC (reverse complement);

Reporter 2 (FAM) Sequence:
(SEQ ID NO: 25)
TCAACAAACTGCTCCC (reverse complement).

Gene expression analysis in human liver biopsies—For human liver biopsies, mRNA expression of the different PSD3 isoforms, and of PSD3 and NAT2 in FLD vs. non-FLD was measured in 77 participants from the Milan subset of the LBC. RNA sequencing was performed using the Illumina HiSeq 4000 platform (Novogene, Hong Kong, China) and RNA reads were mapped against the human genome, and the gene read count (Ensembl human transcript reference assembly, version 75) was determined using RSEM software. To quantify gene expression, the RSEM per gene count data were normalized using the DESeq2 package. Informed consent was obtained from each patient, and the study protocol was approved by the Ethical Committee of the Fondazione IRCCS Ca' Granda, Milan, and conformed to the ethical guidelines of the 1975 Declaration of Helsinki.

Gene expression analysis in immortalized cells—RNA was extracted with the RNeasy Plus mini kit (Qiagen) and retro-transcribed using the high-capacity cDNA reverse transcription kit (Thermo Fisher Scientific) according to the manufacturer's instructions. Gene expression was assessed by real-time qPCR using TaqMan probes and master mix (Life Technologies) according to the manufacturer's protocol. All reactions were performed in triplicate. Data were analysed using the $2^{-\Delta\Delta Ct}$ method.

Gene expression in mice—Liver RNA was purified using the RNeasy kit (Qiagen, Hilden, Germany) and subjected to quantitative PCR analysis. The Applied Biosystems StepOne Plus RT-PCR system, which uses real-time fluorescence RT-PCR detection (Thermo Fisher Scientific, Waltham, MA), was used to quantify RNA expression. PSD3 mRNA was quantitated using the primer probe set Mm01351099_m1 (Thermo Fisher Scientific Waltham, MA). RNA transcript levels were normalized to total RNA levels using Quant-iT RiboGreen RNA reagent (Thermo Fisher Scientific, Waltham, MA). For lipogenic gene expression, total RNA was isolated from mouse livers with an RNAeasy kit (Qiagen, Hilden, Germany). 100 ng total RNA for each sample was used to generate 3'-end RNAseq libraries using the Quantseq Kit 3'mRNA kit (Lexogen, Vienna, Austria). These libraries were pooled and sequenced on a NextSeq500 sequencing instrument (Illumina, San Diego, CA) to a read length of 50 bp and depth of 3-5 million reads per sample. Reads were mapped to gene models using Salmon (version 0.7.1) using quasi-mapping based quantitation mode and automated libtype detection (Patro, R., Duggal, G., Love, M. I., Irizarry, R. A., & Kingsford, C. Nat Methods 14, 417-419 (2017)). Salmon (version 0.7.1) provides fast and bias-aware quantification of transcript expression and gene abundance were reported as transcripts per million (TPM) by normalizing gene-associated reads by total mapped reads per sample.

Cell culture—In basal conditions, rat hepatoma McArdle (McA)-RH7777 cells (homozygotes for 180T that corresponds to 186T in human PSD3 according to the alignment of human NP_056125.3 and rat XP_017455908.1) was purchased from ATCC and cultured in DMEM containing 10% foetal bovine serum (FBS), and human hepatocytes Huh7 (PSD3 L186L) was purchased from JCRB cell bank, Japan and cultured in DMEM (low glucose) containing 10% FBS. In experimental conditions, 24 hours after seeding cells were transfected with scramble or PSD3 siRNA (against rat or human gene for McA-RH7777 and Huh7 cells respectively) and grown in FBS-free regular medium plus different supplementations. A mixture of 3 human siRNA (Thermo Fisher; catalogue #4392420) was used. The human PSD3 siRNA are further described in Table 1 below.

TABLE 1

| siRNA designation | Sense sequence | SEQ ID NO | Antisense sequence | SEQ ID NO |
|---|---|---|---|---|
| siRNA1 (s23655) | GUAUUGGAAGUAC UACUAAtt | 26 | UUAGUAGUACUUC CAAUACga | 29 |
| siRNA2 (s23654) | CGCUAUGAAAUGU AUGUCAtt | 27 | UGACAUACAUUUC AUAGCGgg | 30 |
| siRNA3 (s23653) | CAACGAAUUUAGC AAACUAtt | 28 | UAGUUUGCUAAAU UCGUUGtt | 31 |

In the case of rat siRNA, a mixture of 3 siRNA (Thermo Fisher; catalogue #4390771) was used. The rat PSD3 siRNA are further described in Table 2 below.

TABLE 2

| siRNA designation | Sense sequence | SEQ ID NO | Antisense sequence | SEQ ID NO |
|---|---|---|---|---|
| siRNA1 (s153470) | CGUUAUGAAAUUU AUGUCAtt | 32 | UGACAUAAAUUUC AUAACGgg | 35 |
| siRNA2 (s157481) | CCAGGAACGUGAG CGAAUAtt | 33 | UAUUCGCUCACGU UCCUGGgt | 36 |
| siRNA3 (s157482) | CAACGAAUUUAGC AAGCUAtt | 34 | UAGCUUGCUAAAU UCGUUGtt | 37 |

Quantification of intracellular fat content—Intracellular neutral fat content was visualized by Oil Red O (ORO) staining. Images were acquired using an Axio KS 400 Imaging System and AxioVision 4.8 software (Zeiss) at 100× magnification. The ORO-stained area was quantified by BioPix as previously described, for example, in P. Pingitore et al., Hum. Mol. Genet. 25, 5212-5222 (2016). Before staining, McA-RH7777 and Huh7 cells were transfected with scramble or PSD3 siRNA (against the rat or the human RNA respectively) and grown in FBS-free regular medium supplemented with 50 µM (McA-RH7777) and 25 µM (Huh7) oleic acid (OA) for 48 hours.

De novo triglyceride synthesis—McA-RH7777 and Huh7 cells were seeded in triplicates in 6 well plates. Twenty-four hours after seeding, cells were transfected with PSD3 siRNA or scramble (Scr) siRNA for 48 h in DMEM with 10% FBS. Forty-eight hours after transfection, cells were incubated with DMEM with no FBS+5 µCi/ml $^3$H-glycerol (Perkin Elmer, MA, USA)+50 µM oleic acid (and 25 µM oleic acid for Huh7) for 15, 30 or 60 minutes. Cell lysates were collected and lipids were extracted with chloroform:methanol (2:1) by Folch extraction procedure. The organic phase was dried, resolubilized in methanol and separated by tin-layer chromatography (TLC). The spots corresponding to triglycerides were visualized with iodine vapour and added to vials with scintillation fluid. Radioactivity was measured by scintillation counter as disintegrations per min (DPM).

Apolipoprotein b secretion—McA-RH7777 cells were grown in T-25 flasks and transfected with PSD3 siRNA or Scr siRNA in DMEM with 10% FBS. Forty-eight hours after transfection, cells were incubated with DMEM with no methionine and cysteine for 2 hours followed by treatment with 0.05 mCi/mL $^{35}$S Met/Cys (Perkin Elmer, MA, USA)+50 µM OA for 2 more hours. Then, cells were incubated with chase media, composed of DMEM with surplus of cold L-methionine and L-cysteine (final concentration 10 mM, Sigma Aldrich, MO, USA), for 5, 15, 30 or 60 minutes after which media and lysates were collected. Apo-b was then immunoprecipitated using agarose beads coated with Apo-b antibody (Dako, Denmark). The samples were eluted from beads by boiling for 5 minutes in 60 µl SDS PAGE sample buffer containing beta mercaptoethanol, and subsequently separated on 3-8% gradient SDS-PAGE. The gel was then dried, exposed overnight onto BAS-MS film and visualized in phosphoimager (Fujifilm FLA-3000, Tokyo, Japan).

Beta oxidation—McA-RH7777 cells were grown in triplicates in 6 well plates and transfected with PSD3 siRNA or Scr siRNA. Forty-eight hours after transfection, cells were incubated for 2 h with 8.5 µCi $^3$H-palmitate plus 55 µmol/L palmitic acid in DMEM with no FBS. Then, 500p of media was collected and the labelled palmitate was precipitated by adding 50 µl of 20% BSA and 27 µl of 70% perchloric acid. The supernatant was collected after centrifuging at 12,000 rpm for five minutes and a second aliquot of 20% BSA was added. This was repeated for a total of three times. Then, the final supernatant was added to vials with scintillation fluid. Radioactivity was measured by scintillation counter as disintegrations per min (DPM).

Results—A total of 3 missense variants in 3 genes were identified in Europeans (minor allele frequency (MAF)>5% from the 1000 genome project, dbSNP Current Build 154 Released Apr. 21, 2020) and that were nominally associated (P<0.050) with liver fat content in the DHS by using a linear regression analysis under an additive genetic model adjusted for age, gender, and the top four principal components of ancestry (FIG. 2). Among these variants, TM6SF2 (rs58542926; P=5.7×10$^{-8}$) and GCKR (rs1260326; P=0.007) are two well-known genetic variants associated with fatty liver disease and with circulating triglycerides associated with increase liver fat content in the DHS (see e.g., E. K. Speliotes et al., PLoS Genet. 7, e1001324 (2011)). The variant in the PSD3 gene, rs71519934, was also found to be associated with lower liver fat content (P=0.049). Differences in clinical, anthropometric, lipoproteins, and liver fat content were also stratified by ethnic group (FIG. 17) where there was an observed reduction in circulating total cholesterol levels for the PSD3 rs71519934 genotype in European Americans.

The variant PSD3 rs71519934 was examined in the LBC (comprising n=1,951 Europeans at high risk for FLD with liver biopsy available) to identify any association with protection against FLD (FIG. 3). In the LBC, the PSD3 rs71519934 minor allele (186T) was associated with lower prevalence of liver steatosis (P=5.9×10$^{-6}$), fibrosis (P=0.006), inflammation (P=9.9×10$^{-7}$) and ballooning (P=0.002) (FIG. 4) by using binary logistic regression analysis under an additive genetic model adjusted for age, gender, BMI, center of recruitment, and PNPLA3 rs738409.

Figure 5A:
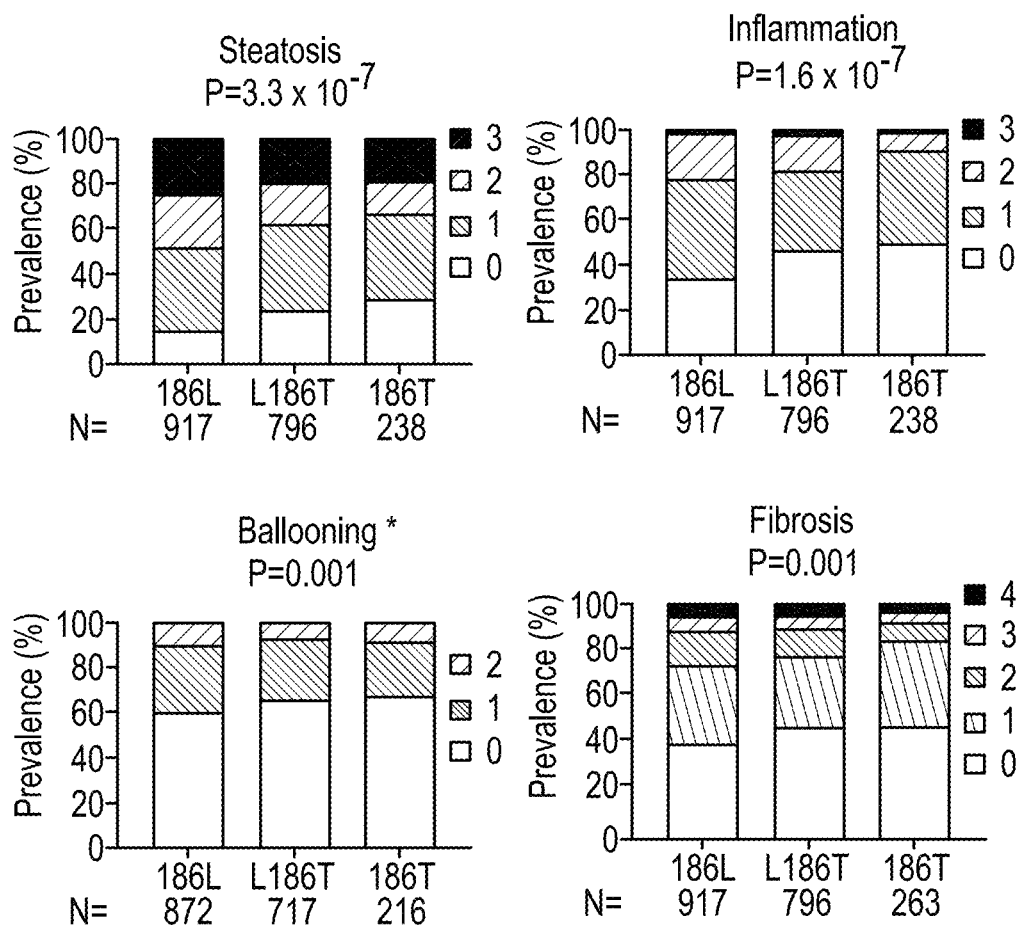
FIGS. 5A-C shows that the PSD3 minor allele protects against enhanced severity of histological liver damage in the Liver Biopsy Cohort (LBC) and its gene expression is higher in livers with FLD.

Additionally, carriers of the 186T minor allele were protected against a more severe liver steatosis (P=3.3×10$^{-7}$), inflammation (P=1.6×10$^{-7}$), ballooning (P=0.001) and fibrosis (P=0.001) (FIG. 5A) by using ordinal regression analysis under an additive genetic model was used and adjusted for age, gender, BMI, center of recruitment, and PNPLA3 rs738409. These results were virtually identical when further adjusted for other genetic (TM6SF2 rs58542926 [E167K], MBOAT7 rs641738, and GCKR rs1260326 [L446P]), and environmental (presence of diabetes and cholesterol treatment) variables influencing FLD (FIG. 16). Moreover, carriers of the PSD3 186T minor allele had lower circulating total and low-density lipoprotein cholesterol (LDL-C) levels (P=1.4×10$^{-6}$ and P=0.001, respectively) (FIG. 7). A genetic variant in HSD17B13, resulting in protection against FLD, was shown to interact with the PNPLA3 variant and carriers of the PNPLA3 deleterious allele gain more benefit from carriage of the HSD17B13 protective variant (see e.g., H. Gellert-Kristensen et al., Hepatology, (2020)). Therefore, the interaction between the PSD3 and the PNPLA3 variants in the LBC was tested but no interaction was identified between these two genetic variants on liver disease.

The effect of the PSD3 variant in white-British participants (n=10,970) from the UK Biobank with measurement of liver fat content by magnetic resonance imaging derived proton density fat fraction (PDFF) was carried out to understand the PSD3 variant association with liver fat content. Genetic data on the rs71519934 dinucleotide substitution were not available so rs7003060 was analyzed (that is in complete linkage disequilibrium (D'=1, r$^2$=1) with rs71519934 in Europeans). No association was found between the PSD3 minor allele and lower liver fat content in the UK Biobank. However, since genetic variations affecting FLD have a robust gene-environment interaction with excess in body weight amplifying their effect (see e.g., S. Stender et al., Nat Genet 49, 842-847 (2017)), the interaction between the PSD3 rs7003060 and BMI toward liver fat content (measured by PDFF) was analyzed in the UK Biobank by including the BMI×rs7003060 interaction term in a linear regression analysis adjusted for age, gender, BMI, first ten genomic principal components. It was found that this variant interacts with BMI (P=0.046) with higher degree of BMI uncovering the protective effect of the rs7003060 variant against liver steatosis. The differences in liver fat content among PSD3 rs7003060 genotype after stratification for severity of overweight/obesity measured by BMI indicated that severely obese (BMI>35) carriers of the PSD3 minor allele had lower liver fat content (beta=−0.175, P=0.02) (FIG. 18).

The interaction between PSD3 genotype and BMI in the LBC was further validated by testing the association between the PSD3 variant and the protection against liver disease in individuals in the Independent Replication EU Cohort. It was found that the PSD3 minor alleles was associated with lower prevalence of liver steatosis (P=0.024), fibrosis (P=0.049) and ballooning (P=0.047) and with less severe fibrosis and ballooning (P=0.040 and P=0.048 respectively) (FIG. 6). No difference in clinical or metabolic traits were detected in this cohort stratified by PSD3 genotype (FIG. 7). A meta-analysis of the two cohorts with liver biopsy available was performed, namely LBC and the Independent Replication EU Cohort. At both fixed and random effect models, the genetic association was stronger for all the traits examined except for the inflammation presence and severity where the association was attenuated by using a random effect model (FIGS. 8A-B).

Figures 5B, 5C:
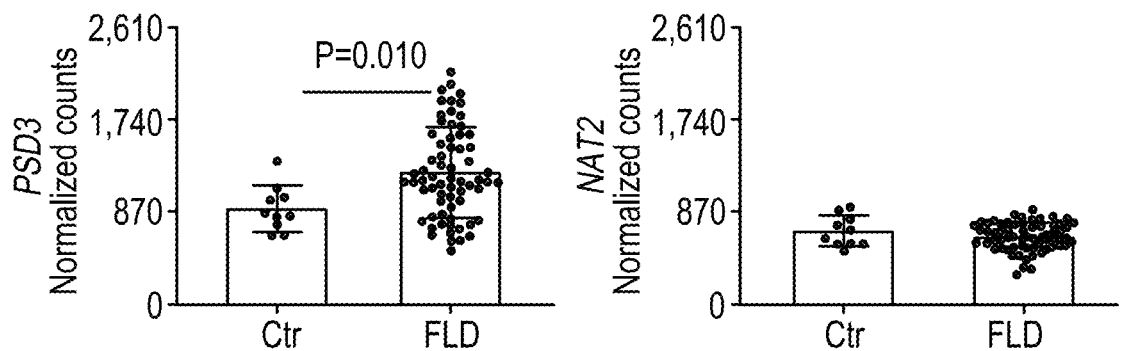
Figure 9A:
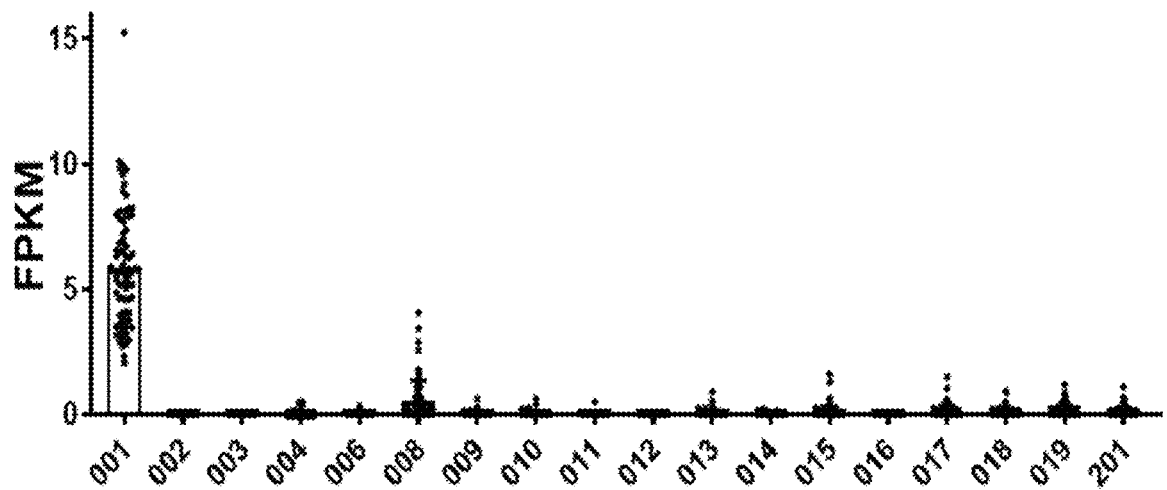
FIGS. 9A-C shows that PSD3 mRNA isoform 001 has the highest expression in human liver tissue, as described in Example 1.
Figures 9B, 9C:
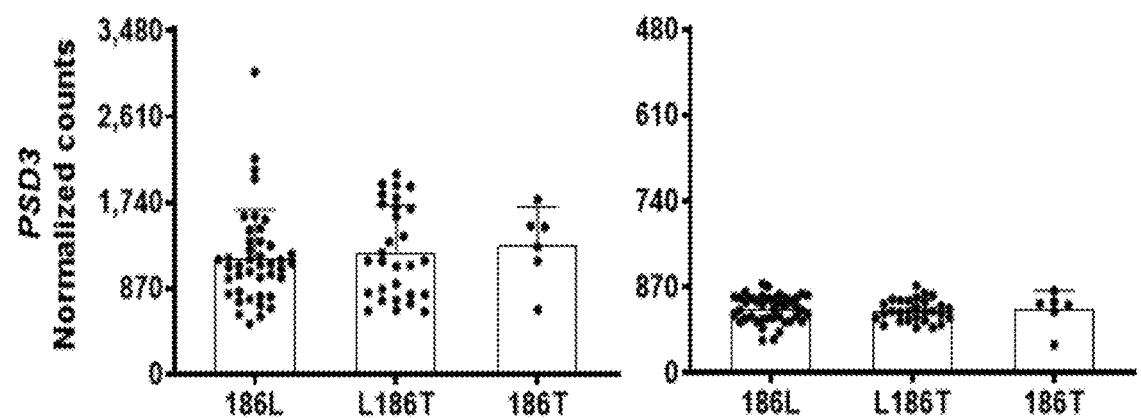

PSD3 Expression in Human Liver and FLD—The PSD3 protein has 18 annotated isoforms (Ensembl release 75). By reviewing the transcriptome of liver biopsies from a subset of individuals (n=77) from the LBC, it was determined that isoform-a (annotated as NP_056125 in NCBI and as 001 ENST00000327040 in Ensembl) had the highest expression level in the liver (FIG. 9A). The total liver PSD3 mRNA levels were higher in livers with FLD than in those without (FIG. 5B) while no differences in the NAT2 mRNA level were observed (FIG. 5C), which suggests that PSD3 and not NAT2 is involved in FLD. When we stratified individuals based on the PSD3 genotype, no difference was identified in the mRNA expression level of either PSD3 or NAT2 (FIGS. 9B and 9C).

Primary human hepatocytes from donors carrying the 186L and 186T aminoacidic change in homozygosity were compared to elucidate the mechanism underlying the association between the rs71519934 minor allele and lower liver fat content. Consistent with the genetic association, human primary hepatocytes homozygous for the 186T allele cultured in 2D had lower neutral lipid fat content (p=0.007) measured by Oil Red O staining compared to homozygous 186L hepatocytes (FIG. 19A). To examine PSD3 levels in the two different genotypes, we generated an antibody specific for the human PSD3 (polyclonal antibodies directed against recombinant PSD3 were generated after immunization in rabbits and the lead antibody was validated via siRNA silencing of PSD3 in human hepatoma HepaRG cells omitting the signal in a Western blot analysis). Cells were incubated with different amount of oleic acid (OA) (0, 10 and 25 μM) and protein levels were examined between the two genotypes in primary hepatocytes. Overall, the amount of PSD3 was elevated with increasing amount of oleic acid (FIG. 19B). However, for each oleic acid concentrations, PSD3 protein expression was lower in cells homozygotes for the 186T allele. Differentially expressed genes (DEG) involved in lipid homeostasis by RNA-Seq showed a robust reduction in genes involved in triglyceride synthesis and secretion, and cholesterol biosynthesis while the expression of PGC-1α involved in mitochondrial biogenesis was increased (FIG. 19C).

Example 2—PSD3 Downregulation Via SiRNA Confers Protection Against FLD

Results from Experiment 1-PSD3 Downregulation in Rat Hepatocytes

Figure 10A:
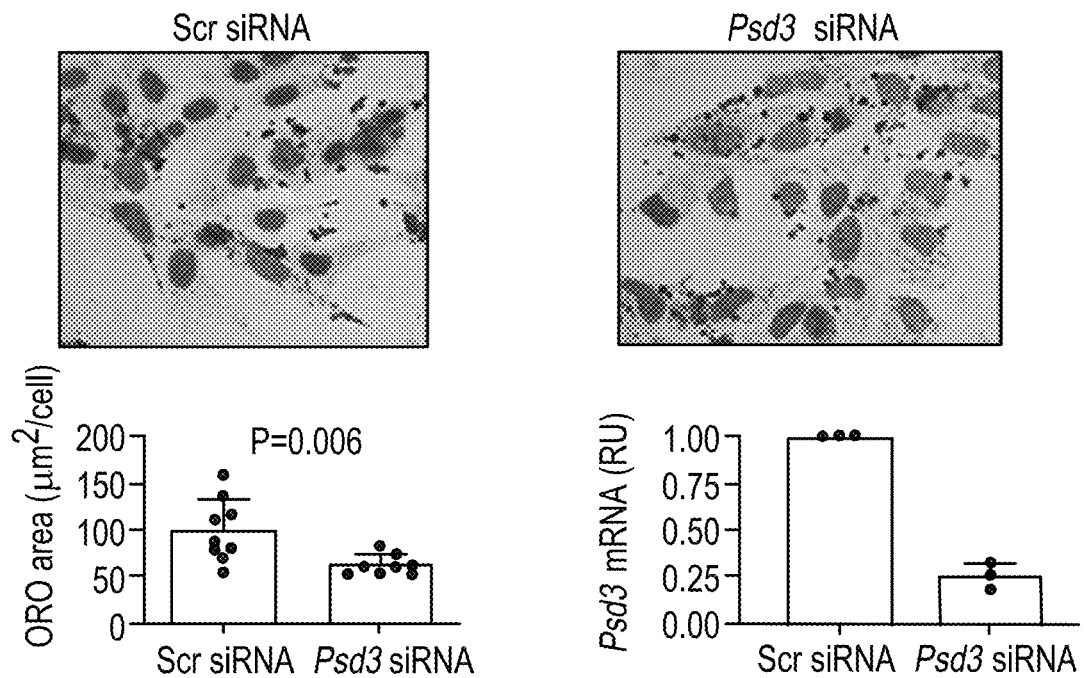
Figure 10B:
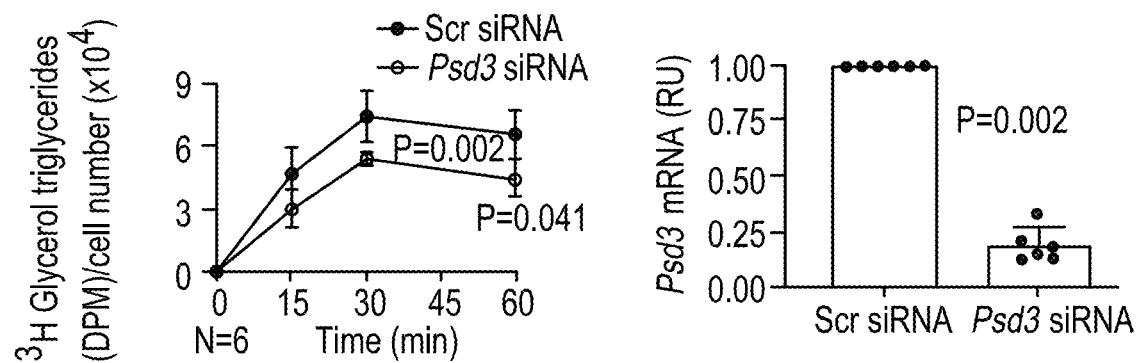
Figure 10C:
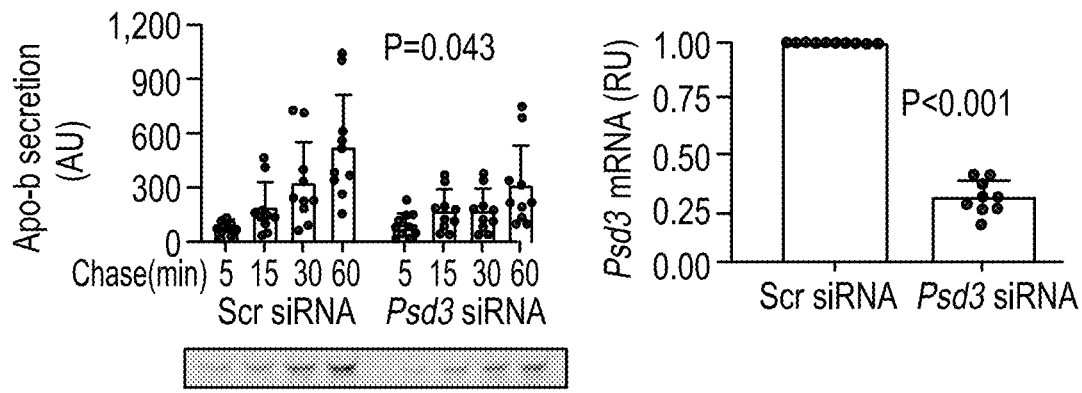
Figure 10D:
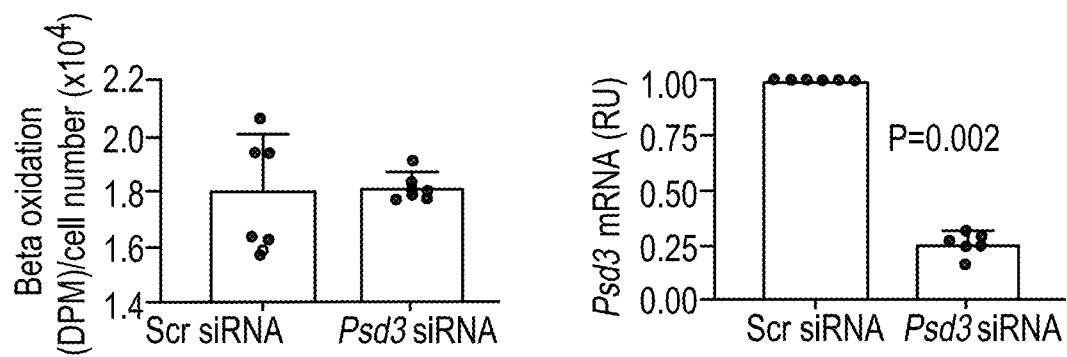

The hypothesis that PSD3 downregulation would result in a reduction in intracellular fat content was tested by using siRNA in rat (rat hepatoma McArdle cells [McA-RH7777]) immortalized hepatocytes homozygotes for 180T that corresponds to 186T in human PSD3. In these cells, PSD3 downregulation resulted in a reduction in the intracellular lipid content as measured by ORO staining (FIG. 10A). Additionally, PSD3 downregulation in McA-RH7777 cells resulted in lower triglycerides production, measured as de novo triglycerides synthesis, (FIG. 10B) and as mRNA expression of genes involved in triglyceride synthesis (FIG. 11). Moreover, very low-density lipoprotein secretion, measured as apolipoprotein-b secretion (FIG. 10C) was also lower compared to scramble control siRNA transfected cells. No differences were detected in intracellular lipid utilization, measured as beta oxidation ((FIG. 10D). The intracellular lipid accumulation (FIG. 12A) and the triglyceride synthesis was replicated to confirm data by using radiolabeled tracers in human hepatoma cells, Huh7 cells, carrying the PSD3 L186L allele variant after PSD3 downregulation (FIG. 12B) and obtained virtually identical results. Thus, downregulation of both endogenously expressed PSD3 threonine and PSD3 leucine resulted in decreased intracellular lipid levels.

To test whether PSD3 downregulation results in changes in ARF6 activation, PSD3 was downregulated in Huh7 cells and levels of activated ARF6 were measured using a GGA3 protein binding domain (PBD) pull down assay. Human hepatoma Huh7 cell were transiently transfected with negative control SCR siRNA (AM4611, Thermo Fisher Scientific), PSD3 siRNA (mix of s23653, s23654 and s23655, Thermo Fisher Scientific, described above) or ARF6 siRNA (mix of s1565, s1566 and s1567, Thermo Fisher Scientific). The human ARF6 siRNA are further described in Table 3 below.

TABLE 3

| siRNA designation | Sense sequence | SEQ ID NO | Antisense sequence | SEQ ID NO |
|---|---|---|---|---|
| siRNA1 (s1565) | GUCUCAUCUUCGU AGUGGAtt | 38 | UCCACUACGAAGA UGAGACct | 41 |
| siRNA2 (s1566) | AGACGGUGACUUA CAAAAAtt | 39 | UUUUUGUAAGUCA CCGUCUcc | 42 |
| siRNA3 (s1567) | CCAAGGUCUCAUC UUCGUAtt | 40 | UACGAAGAUGAGA CCUUGGgt | 43 |

48 hours after transfection, the cell lysates were incubated with GGA3 PBD agarose beads that selectively isolate and pull down endogenous active ARF6 (ARF6-GTP). After precipitation, the active ARF6-GTP was detected by immunoblotting using an anti-ARF6 antibody provided by the kit (FIG. 20A). Cells transfected with ARF6 siRNA were used as a positive control. The knockdown efficiency showed ~60% reduction for PSD3 and ~75% for ARF6 as evaluated by realtime quantitative PCR analyzed by the $2^{-\Delta\Delta C_t}$ method (FIG. 20B). The bar graph shows the relative ARF6-GTP (active) calculated as GTP-ARF6/Calnexin (FIG. 20C).

Results from Experiment 2-PSD3 Downregulation in Human Primary Hepatocytes

The hypothesis was also tested by using siRNA (same as above) on human primary hepatocytes in livers from individuals with FLD. The human primary hepatocytes were taken from donors homozygous for either the 186L or the 186T allele and cultured in 2D and 3D. For 2D culture, after attachment of cells in collagen coated plates, cells were incubated with regular growth medium supplemented with 10 µM oleic acid and transfected with negative control scramble (SCR) siRNA or PSD3 siRNA for 48 hours.

Intracellular neutral fat content was visualized by Oil Red O (ORO) staining and quantified by Biopix in primary human hepatocytes carrying the 186L allele (FIG. 21A) and primary human hepatocytes carrying the 186T allele (FIG. 21B). The average of PSD3 downregulation efficiency was ~80% as evaluated by real-time quantitative PCR analyzed by the $2^{-\Delta\Delta C_t}$ method and western blotting for both donor types. For 3D culture of primary human hepatocytes, spheroids were generated by seeding 2000 cells/well in a 96 well round bottom flask, along with transfection mix in a total of 100 µL medium. For the generation of 186T allele spheroids, 5 nM of FMK-Z-VAD was added to support spheroid formation. After 24 hours, additional growth medium was added to achieve a total volume of 200 µL/well. 50% of total media was replenished with fresh media every 48 hours. After 7 days of formation, spheroids were collected and 8 µM sections were subjected to ORO staining to visualize intracellular neutral fat content. Nuclei were stained with DAPI and ORO staining was quantified by Image J, normalized to number of nuclei of primary human hepatocyte spheroids carrying the 186L allele (FIG. 21C) and primary human hepatocyte spheroids carrying the 186T allele (FIG. 21D). The average of gene knockdown efficiency was ~50-60% as evaluated by real-time quantitative PCR analyzed by the 2-ΔΔCt method for both donor types. Cellular ATP levels as a measure of cell viability remained stable between the negative control scramble and PSD3 siRNA groups.

Example 3—PSD3 Downregulation Via ASO Confers Protection Against FLD

Antisense oligonucleotide (ASO) synthesis—Chimeric 16-mer phosphorothioate ASOs containing 2',4'-constrained 2'-O-ethyl (cEt) at positions 1-3 and 14-16 and a triantennary galactosamine (GalNAc) attached to the 5' end of the ASOs were synthesized at Ionis Pharmaceuticals (Carlsbad, CA) as described previously by Østergaard et al. (Bioconjug. Chem. 26, 1451-1455 (2015)). Two ASOs were used in this study, one with a base pair sequence targeting murine PSD3; PSD3 ASO (5'-GTATTAATACTCTCTC-3'; SEQ ID NO: 1) and the second with a control ASO targeting no known murine gene (5'-GGCCAATACGCCGTCA-3"; SEQ ID NO: 19).

Animals and ASO treatment—All procedures and protocols for mouse studies were approved by an institutional animal care and use committee. All mice were obtained from the Jackson Laboratory (Bar Harbor, ME) and housed in cages on a 12-h/12-h light/dark cycle and fed ad libitum for the duration of the studies. Six-week-old male $C_{57}BL/6$ mice (homozygotes for 147T that corresponds to 186T in human PSD3 according to the alignment of human NP_056125.3 and mouse XP_017168192.1) were fed a NASH-inducing diet (D16010101, Research Diets) for 34 weeks. Mice were then bled and randomized into study groups based on body weight and plasma ALT levels (n=9-10 per group). Mice were maintained on the NASH diet and treated with either saline, control GalNAc ASO (5 mg/kg/wk), or PSD3 GalNAc ASO (5 mg/kg/wk) for 16 weeks via weekly subcutaneous injection. During the ASO treatment period, body weights were monitored weekly. Seventy-two hours following the final ASO dose, mice were anaesthetized, blood was collected via cardiac puncture, and tissues were collected and either snap frozen in liquid nitrogen or fixed in formalin for histological analyses. Blood was centrifuged at 3,000×g, and plasma was collected. The plasma and snap-frozen tissues were stored at −80° C.

Plasma and liver biochemistry—Plasma transaminases (AST, ALT), total plasma cholesterol, plasma triglycerides, low-density lipoprotein (LDL) cholesterol (LDL-C), and high-density lipoprotein (HDL) cholesterol (HDL-C) were quantitated using an Olympus clinical analyser (Beckman Coulter, Brea, CA). Liver triglycerides, free cholesterol, and cholesteryl ester were quantitated as described in T. P. Carr, C. J. Andresen, L. L. Rudel, Enzymatic determination of triglyceride, free cholesterol, and total cholesterol in tissue lipid extracts. Clin. Biochem. 26, 39-42 (1993).

Histopathology and image analysis—After formalin fixation, dehydration and paraffin embedding, 4-µm sections were stained with haematoxylin and eosin (HE) and Picrosirus red (PSR) according to standard procedures. Consecutive sections were immunohistochemically stained for collagen 1a1 (Col1a1, LS-C343921, BioSite, USA) in an automated Ventana Ultra system (Ventana Medical Systems, Inc., Roche Group, USA). Image analysis was performed on digital images using Visiopharm Integrator System software (version 2018.09, Visiopharm, Hørsholm, Denmark). The unstained area (lipids) on HE-stained slides was quantified and related to the total section area. Liver steatosis, inflammation, the FLD activity score and the fibrosis stage were evaluated in the HE- and PRS-stained liver sections according to the methods reported by Kleiner et al (Hepatology 41, 1313-1321 (2005). All histological assessments were performed in a blinded fashion by a board-certified veterinary pathologist.

Gene Expression in mice—Liver RNA was purified using the RNeasy kit (Qiagen, Hilden, Germany) and subjected to quantitative PCR analysis. The Applied Biosystems StepOne Plus RT-PCR system, which uses real-time fluorescence RT-PCR detection (Thermo Fisher Scientific, Waltham, MA), was used to quantify RNA expression. PSD3 mRNA was quantitated using the primer probe set Mm01351099_m1 (Thermo Fisher Scientific Waltham, MA). RNA transcript levels were normalized to total RNA levels using Quant-iT RiboGreen RNA reagent (Thermo Fisher Scientific, Waltham, MA).

For lipogenic gene expression, total RNA was isolated from mouse livers with an RNAeasy kit (Qiagen, Hilden, Germany). 100 ng total RNA for each sample was used to generate 3'-end RNAseq libraries using the Quantseq Kit 3'mRNA kit (Lexogen, Vienna, Austria). These libraries were pooled and sequenced on a NextSeq500 sequencing instrument (Illumina, San Diego, CA) to a read length of 50 bp and depth of 3-5 million reads per sample. Reads were mapped to gene models using Salmon (ver 0.7.1) using quasi-mapping based quantitation mode and automated libtype detection. Salmon (ver 0.7.1) provides fast and bias-aware quantification of transcript expression. and gene abundance were reported as transcripts per million (TPM) by normalizing gene-associated reads by total mapped reads per sample Results—Liver PSD3 was downregulated in mice by administrating triantennary N-acetylgalactosamine (GalNAc)-conjugated antisense oligonucleotides (ASOs). C57BL/6 mice were fed a non-alcoholic steatohepatitis (NASH)-inducing diet for a total of 50 weeks, and during the last 16 weeks, groups of mice were treated with PSD3 ASO, control ASO or saline. PSD3 ASO treatment markedly decreased (−98%) the liver PSD3 mRNA expression level (FIG. 13A) and reduced the liver weight, total liver triglyceride content and plasma ALT level (FIG. 13B-D). PSD3 ASO treatment did not affect the body weight of the mice (FIG. 14A). Moreover, PSD3 ASO treatment reduced the total liver free cholesterol, liver cholesteryl ester, plasma aspartate transaminase (AST), total cholesterol and total LDL-C levels but did not change the plasma triglyceride or high-density lipoprotein (HDL) cholesterol (HDL-C) levels (FIG. 14B-H). Histologically, PSD3 ASO treatment reduced the liver collagen 1a1 (Col1a1) protein and liver lipid droplet levels (FIG. 13E-F).

The severity of liver disease was assessed by ordinal regression analysis and found that PSD3 ASO treatment reduced the severity of steatosis and inflammation and the FLD activity score (NAS), although the liver fibrosis score did not change significantly (FIG. 13G). Expression levels of genes involved in triglyceride synthesis were evaluated and found to be consistent with the in vitro experiments in McA-RH7777 hepatocytes (FIG. 11), PSD3 downregulation in mice fed the NASH-inducing diet reduced the expression of genes involved in de novo lipogenesis (FIG. 15).

All references cited herein, including patents, patent applications, papers, textbooks and the like, and the references cited therein, to the extent that they are not already, are hereby incorporated herein by reference in their entirety.

SEQUENCE LISTING (43 sequences)

SEQ ID NO: 1 - DNA, 16 bp, Artificial sequence
  Synthetic oligonucleotide
gtattaatactctctc

SEQ ID NO: 2 - DNA, 11687 bp, Homo sapiens
aacaaagagcacgcggcgctggccgccggcactcgcgccctgaggctgcggccccggagcgcccggcggcggtttcggcgcgcggccgggctggcgatggaagatggaaggaaggagcgcagcggcagagacatttgtttgggtgaacaatgcatctgcacattcccagagtgttgccaaggccaaatatgaatttttatttggcagatctgaagggaaagctccagatactagtgatcatggaggaagcactttactcccaccaaatgtcacaaatgaatttccagaatatgggaccatggaggaaggtggagaaggcctaagggcttctctggaatttgatggtgaggctctgccatgccacccacaagagcagcagggtgtccagcctcttactggctgccactctgggctcgacagtgttacagaaggaccaaaagatgtcagagaggccccctctcaaagtcatctcaaggaacaaagtttacagcccattgactctttgatttcagctctgaaagccacagaagccagaatcatttccggaacattacaggctacaaaggtactggaccaagatgctgtttctagtttttcagttcagcaggtggaaaaagagctggacactgccagtcgtaaaacacagagagtcaacaaaacgctccctgctggccaaaaaaatttaccagaaatacctctttcagctgaagtaacaacggaggaaagtttttatttgagcatccagaaagatctcaccgcgctgttaactggagacactcaggcagagatttcccagataatgaataatgggaggaaaggggctgtctgtgtgcaggagccatcttgtcctttggcctccctcgggagctcagcagtgacctgccactctgcaggcagtgttggtttcttgaaagagcagaggtctgctcttgggagagagcacccagggggatgtgatcgaagcagctccatgggacgcccaggccgggtcaaacatgtggaatttcaaggagtggaaatactgtggacaggaggagacaagagagagacccagcatcctatagattttgagacatcactgcaaagaacagcctctcctgacagcaaagagtcttccaaagtgccacgccatctcatctcatcagctggtttgtgtaattcaagtagtttaactgagaatgtttgggatgaatcctggaaagctccttcagagaggcctggcactagctcggggacattttcccctgtgcgtcttgatgagagtggagaggatgaagtcttcctacaggaaaacaaacagcatcttgagaagacacctaaaccagagagagacagggaaaggatcagcgaacaagaggagcacgttaagggggaagatgaagacatccttgggcctggatatacggaggactccaccgacgtgtacagctcccagtttgaaaccattttggacaacacttctttatactacagtgcagagtccctggagacattatactcagagcctgatagctattttagctttgaaatgcccctcactccaatgatacaacagcgcattaaagaaggtggtcagttcttggagaggacatcagggggaggacatcaggatatcctgagtgtgtctgcagatggtggcatcgtgatgggctattctagtggcgtcaccaatgggctgaatgatgccagcgactccatctacacgaaaggcaccccggagattgctttctggggaagcaatgctggggtgaaaacaacacggctagaagctcattctgaaatggggagcactgaaattttggaaaaggagaccccagaaaatctcagtaatggtaccagcagcaatgtggaagcagccaaaaggttggccaaacgcctttatcagctggacagattcaaaagatcagatgttgcaaaacaccttggcaagaacaacgaatttagcaaactagttgcagaagaatatctgaagttttttgattttacaggaatgacgctggatcagtcactcaggtatttctttaaagcattctctcttgtgggagaaactcaagaacgagagagagttttaatacacttctccaatagatatttttattgtaacccagataccattgcttcacaagatggagtccattgccttacctgtgcaataatgcttcttaataccgatctacatggccacaatattggaaagaagatgacctgtcaggagttcattgcaaatctgcaaggggtaaatgagggtgttgatttctccaaggatctgctgaaagctctgtacaactcaatcaagaatgagaagcttgaatgggcagtagatgatgaagagaaaaaaaagtctccctcagaaagtactgaggagaaagctaacggaacacatccaaagaccatcagtcgtattggaagtactactaacccatttttggacattcctcatgatccaaatgctgctgtgtacaaaagtggattcttggctcggaaaattcatgcagatatggatggaaagaagactccaagaggaaaacgaggatggaaaaccttttatgctgtactgaagggaacagttctttacttgcaaaaggatgaatacaagccagaaaaggccttgtctgaagaggacttgaaaaacgctgtgagtgtgcaccacgcattggcatccaaggccacggactatgagaagaaaccaaacgtgtttaaacttaaaactgccgactggagggtcttgctttttcaaactcagagcccagaggaaatgcaagggtggataaacaaaatcaattgtgtggcagctgtattttctgcaccaccatttccagcagcaatcggctctcagaagaagtttagccgcccacttctgcctgccactacaacaaaactgtctcaggaggagcaactgaagtcacatgaaagtaagctgaagcagatcaccaccgagctggccgagcaccgctcatatccccccgacaagaaggtcaaagccaaggacgtcgatgagtacaaactgaaagaccactatctggagtttgagaaaacccgctatgaaatgtatgtcagcattctcaaggaaggaggcaaagagctactgagtaacgatgaaagcgaggctgcaggactgaagaagtcgcactcgagtccttcgctgaacccggatacttctccaatcactgccaaagtcaagcgtaacgtgtcagagaggaaggatcaccgacctgaaacaccaagcattaagcaaaaagttacttagagtccatctgcggccaggaagtgctggtcatggagcaaaatagggtttttcaagatctttctggtaatccgtgaatatatttaaaaaaaaaaagtctgtgacaaaacggtgcattagtaattttttctattgtatatttttgttagtttctgtacagattgtctttgctcttgatttcttttgctttgatgatttttgcaacttgatagctaatgcaccttttctgtgaggaggaggggatcgtgatttcagaatgaattatgtatcccttctcttttggttttctcttgtttgcagtctgctcagttgttttatgtattctcatatcaactgttaaacttttttttaaggttaaagaatttaatccattgtgaaacacttaactggacaaactgtagttttagtaaattctagctggagttaatatacgcctttatatgtgaaatcttgcccagtcacagaggtagaattgagcactcacagatgctccagtaagaatcacagtgctgggaatctagttgctccaatatgaggcagcttcatgtgcagcttagcacttgttgttgagatcggaccctgctggaagcagggaaaagaagcgtgaagatcgtaggattgagaacttagggaagcacattagcttgcttgaagtgctgattccatttcagccaagcaagggaaagaggaagtggagtcattttgcctttgaaggctgaggaaagattgatacccagttaattttgtttgctaaaggatgggggcaataatcggcccttgaggagctgcagcagtaggcatgtgctcagtctgcaggaattgttacctcactcccacagggtctagactagaaatccatcatctctatcgttgatatccttccatccaggaatagatttttcttactctacatatgtgtgtgtgcgtgcgtgtgtgtgcgtgtgtgggcatggggttgtgtcctggttgtgatattgaggtcttccttcctaacaaattaatactaaaatgaaacagcttttcttgtgtccttaagacaaaataaggaaggaaaacgtagctgcagttgtccacgatggatattggttctttaaaatatatctgaaagtagtagtcagaatgaattatggttggaaaactgaggaatcttctggttgcaggtgcaaagtgactttgtttattcttgtctcagtctccttgatagccacttcactctgctactactcaactttctcctaaaaatacttcatctattttcagtcctttctttctgtctactcaaaatggttctattaactttgcagtcatgagcttgttccagttacagtccctttgaagttcagggtgataaacagaatattcttctgtagaggaagagaaaggagtgaaagtttagcccactgagacctagagctttgtgatttcctaaccttgaaactctgtaatccctaaagttaaaatctccgcaagtggcacaacttcagaactaatagtatcactttgatttttctttttcctcccttagaaagtttctctagttctatagtttatttgttgaaggtactatgaccaaagaatcagctgctctacaggaatagcatggttccagtgaattagagaaaacctgctgtaaagccatggtagtgtctaagtggtatgttattatgatgtactagcatttatttacagaattatttattaacgtttacttccttcccctctgtaaatgtccatgactattgcccagagaaggcttacccctctctagggttgcagttgctttctttgtaataagtattttgccacacctgtaaaaaaaaaaacctcacttttaactctctgccttgtttgggtaaaggcagtaactaagtttatgtttcagaactgcaaaacaaacaggatagttaccaatatggcccatgtatcagattgatttttgtagcctctcactgaatccaacatatccacaagcaagttatctgtctttctacctgataatctaaattatcaggatatttgttttctgcctaaatgtttatactaagccgaggggagagaggtacctagaccatgtcatctacaagcttcagtaactaaagaaaaaggaacttccctgagtggcttgaatgtgtttgcccacagtctatatctatgtatatagaatgtctgtatgtattttacttatttaatatacattgaatggtaccttgctacagtatttctgacatttagagtagtgttgaaatactcggctagcatcagcaccactatagcactgtccgtgtcatatgagtcactaatattaactccagggacttctggataggctaatagatcattggatacgaagggctcttttgaagcttcagtataccatgtttgcatagtttatctttaaaaacaactttaaaggttcttttgtgagccaggatctcagactgccgtagcatgatgctgtccatctttagcgcatgggctgagaacacctcttccctgaggcttctgaaggttgctgtctgtcatgagtgcatgaaggaggccaagagtttatgctatgggaggaaacagtcactgatttgcctagattctgagagtctggcccatagccaaccacattttcctttgggataatttatttcctgtggcatctagccagaagaaattgaggatgtttcctttcacagctgctccaagcctgttgcccaattcacggtacaagggagcaccccttccctttcctctgaaggtacgccacccacctccgtcgcccacctcagcgcccaggagccttgggacttccttccatatgataaatcattcttcttcacgtcaatacacttcatattaatttctagtacagaaaatcttgacagctatcagaatgccttggtcatagtgttgttgcaaaattgaccatacaggtggcccatgtataaaatctgaattttaggggtttgtccccacctcgcatgctggcttttacagggaggtgtctgggattcctcattagcaatcaaaacttaattactgggatgcagagtccttactttatcgccagcccgtaggcatttctgaagtgcacttttttgaaacatcattttgctaactctcagcagtgtctaattaaactgagcaatacttttgtgaattttaattaatctcagcaaaaccatgatgggagagagtcctctgatggaaatgtagtccctggattatgtgtaacctttttattcctcttagatgcagaggatagaaagcattttttggtgcagtggtcttgtggcaaacacaagaccctctatgcgtctccaactgttatcctaatctagaaaatgaggactggcccctgggcaaaagtgacatgaggaatttactctggaagaggaaaatctgggtggctttccaaggctaagataggtttgtatttcaccctgtggccaagctacagaacttctgagattgtggaagaatttttgcaaccagcagggaaagaggcctcttactgcctaaacacaaagttacactgagcttttctactgtcctttgcctattgctccctctatcatgtaaagatctgggaaggatgagaggcagggcctgcttgtcatgagctgcactcttttctttttaactaatcattgacaattggaagaaaattgacgttaaagaagtttctccattgtcttactaacaaaaccttttgggtttcattaattgtccttgaaattgagttcctttggcatttttccttgcagtcatcagttaagcatgttgcatcctgaattcacagaagtttagctttgcaggtttgaatctctgtaatttaactcccgtggacttggtcgagttttcagcaggttgggagccacctctcttcatttcagcagtgagtcatcccttgacttttcaaatgacagaattttttccaattgtaaaattagcactgtaaaacaaagaaccaaagtggcatcctaagagttgttaaacctgaagtctagtttatgaggaattgtccaagttggagtttaaatagtatctgcttttgtctcaaagcatctaagttattctgacagaaaatggtaagtcagctttgcaggcagatgcgcctctgggcctcctaccttgctccacagctttctggccatcttgtctcccaggccatgccactgctctgccacatgtcagcaaatttctttccaccagtcttatagcatcttacatgatcaaatcatcacagaataaccccgtgatagattattgatagcaatagagaggggctttgtcactgatttttctctcagattccttttccatctctcatccataaaggaaggactgaaatccaaaggcattctccttttgtacctacagtatccagaacccacgtgggcagccttctgcttatgacaataattggcccattgcatgcagagagaatgtcttcatagagagaatgtcattaaatacttgaatctgcatgacagtttgacttgaatgcaacagcaggaaaattttgcaagttacataattgtatatacagtaggttttcttaagtctcttcggttcatcctttgtaatttgtgtgtgtatctgtagtattgcaggcttttggagactattcttacaggcagtatgtcagtcatcaaagaaaatgctgtcacctgccattgttgtatttgtgggtatttatagttgtatgtatgtaaatgcatcagtgtgtagattgcatatcagtgtatggtacatgtacatcaaaattatttttgtccttaatcagtgtgatatgaaaagcaagtacaacctcataggactgattatataatgaagttgttgagagtatatatagtggtattgttttattaaacttaaactcaaataatattttgattaaaatttttaataagactttatgctagaaaattctttgagctttgaatcaccagggcaaaaatgactttcaactaaccttgtgaatcttttgcagtgtactgtgtgcaataccaagggcatagctccctgtaatttgggaaatacagaaagaaaagaaaaaaaaaaaaaaaggcagcctgtgcagtcttagtaactttagtattaagagcacttaaagtcaaactgacaattttgggcttattacaaaatgtgatgctttaaagcacacgttctttattgttgttgtaattagtccataaaaaatatagctttcggaagaattaagtacccaccatatcatttatgtatttgtgtatgttttacgggagatcaaaccactctcgtggtgccgcatccgtactcgcttgacttggaagaaatatcacaagcactaaagtatatcagggcatcccaggattgggtactgtatcctaggtttgcagttgcagaaattagcatctagtgtcacaggtaaaagaatttcaggaccaggtttaaactttattttaaatatttttatacttaggtctctttttcctgcctctccccaaagaagagccactggccttagttgtttgagcttactgcttatattatagagtgtaaataggtaactagagactaaaattttattaaccagcatgtttggtatatttaaagcagtgactgagtgtgtttgagtgagtggctgagtgcagtgtcttttgtttaaacacactgcctcgtgtctttgtagctgattcagagagtttgaattgtggggtgggagactaacttcagctccaggctgcagtaatgtgttggtagttacacttgaggcatttttttgttgttgttaattaactctatagtctcaaactatttttgcaaatatatcatttttcctaattggttcttgacgtgcagtggactggctctgtgaatgattggcagggtcttagttttgcgagagtatttccttctaagaattattgtgatctgcagaaacagccatttgattcaaaaatcatgtagaaaaggagtaggagaagcaaaacgtttcatttttgggccttaaccatttgaaatgtttggactttaaacataaagccatggagtttataaagccaagtaaccatttgatatggataataatatctactctagagagagtatatatatgcacattgatttttaatgctgttaagatacttttgtaaaactgtaggaacaagagtaattagaccaaattgaagcttaggggacagtaaagtggttgctttccatttagggtaaccatgcatgtggttagtcctctcctcctgagattcagaaccagttgactgtccccttaggtgtataaggagaaaagttgacatgtctgggacctctgacatgtgtacacatgcttgcacacatgcacacacagtgaatgttttaagttatacaaacataagaccttaagatgcaaagagccagaatattctaaagaggtgatgaacagagggggtggaaactgcatcacagatgttttccaagggccagggtggaatctgagctctagtgtctgactttgagatgcattatatttttaacacataaatgaggggatccatatcacattctttcttgtggaccaccaaattgaaggctttcttgtaattcacaagcagcagctctccagcatctctccgtagcctgggtgaagtcccagaagctggtgtgcatcattttccaaggtggcagagctgcttgctctgcagatcattcctttgagagaggagtacaagtgaagaaacaaggaggcacttcctgtaggagcactgatgtgccttgtccacactcccctctgagctttactggtaagagagctccgactgaacatgctgagcagttgagcacttttccatcagcaacaacagcgaggatggaaatggaaaggaaccgaactaaaatgcatttccctttgcagggcagagagctaagctcttaggaatagtgttatagaaataagcaccctaacttcaattcctgaaaatgttggttaatggagagaattttggagtttcacttaatattttcccatcggtcgccataaataagtcttcaggcgctcctagaagagtcccagcccaaggctcgattaaggaccacactgcaggtctgaggctcactgctctgagtcctgaacaccagagccctgcagagagtggtgataacacatcatctctgcaaagaggaacctctcccccggccgccacttcactcaggcttctactgagcagcaaggacagcctgggtttcaaatgccacttcccctgctttagggatccaggtgtcctgatagcgtgaccctgctgaggcaaggtatcaactccgagagtgactgagtcactgagcgtggcacatgaacaaacgtcatgacaaagattctctgagtgaagttaacaccacgtattttacctttgcaaaaaacaaactggcaccctgagttctaactacggacggacgatatctttgcctccacacccagattcctggaaatggctaacgtttcctttctaggggaagggtcgaggaatactcaagtgctagcttagcagctttgttcagtccagatcagagctgttaggtaaaggcctaaccacctccctgcagtctcttatatctcaagctttaggaacccatttctaaatgtacactagcggagaatttatattgtcagccttgattaccataggacaggcagaaaggcgataatttgtatcttttaatataaaagaagcttttaacttttccagcctattataataactgagttatattcactgtggctcaaactaattggcattgtggaacatttctttaccttcaaagttttctccaccaatcatttcagttctattgcagtcctggtgccatatgtcccctgcaaattgtgaaagtaattagtgacaaaatagcagcctgctccttttcaatggcgaaactgtcggcattagcagttttgggtaagctggcggtactataacacgtactggaaacctgttcctcatcaccacctaccagattctggaaatgccgtcttctagaaaacgatggcgtttgtggtggtcttcttttgaaaggaacagtaatttgtgtggatattgttaaagtgtttaaagaatattttgacaattaagtttacattttacaattgctttattttttattaaaatagttgtatataaatattaccctatttcactgttgttcaagtaaatctaaaccttgtagacaagtgagtcatctgatatgtatagaagctgtgatatatagagtacatttattgtgtaaatgtttatgaatataattgttcctgtgtttttataagttggggatattttgttgttttacggcaacaaaatttattgcatttaaatggtttttatgtaatagaaatcacgcaaaatagtgaaggatttaaaatatgtatatgatacatgtaaatgtacaaactttagaaagaaataaatccaacaaatttcaatca

SEQ ID NO: 3 - DNA, 10091 bp, Homo sapiens
aggttcttggaaggctgtgaggctcggcagtcactgaacttgggagctgaagaatactggacggggcttcggagaggaaggatggtccaggcgcaccccaggggttgcgatgggctcttcttggtgtctgtatggttgctgcaatgctggggtgaaaacaacacggctagaagctcattctgaaatggggagcactgaaattttggaaaaggagaccccagaaaatctcagtaatggtaccagcagcaatgtggaagcagccaaaaggttggccaaacgcctttatcagctggacagattcaaaagatcagatgttgcaaaacaccttggcaagaacaacgaatttagcaaactagttgcagaagaatatctgaagttttttgattttacaggaatgacgctggatcagtcactcaggtatttctttaaagcattctctcttgtgggagaaactcaagaacgagagagagttttaatacacttctccaatagatatttttattgtaacccagataccattgcttcacaagatggagtccattgccttacctgtgcaataatgcttcttaataccgatctacatggccacaatattggaaagaagatgacctgtcaggagttcattgcaaatctgcaaggggtaaatgagggtgttgatttctccaaggatctgctgaaagctctgtacaactcaatcaagaatgagaagcttgaatgggcagtagatgatgaagagaaaaaaaagtctccctcagaaagtactgaggagaaagctaacggaacacatccaaagaccatcagtcgtattggaagtactactaacccatttttggacattcctcatgatccaaatgctgctgtgtacaaaagtggattcttggctcggaaaattcatgcagatatggatggaaagaagactccaagaggaaaacgaggatggaaaaccttttatgctgtactgaagggaacagttctttacttgcaaaaggatgaatacaagccagaaaaggccttgtctgaagaggacttgaaaaacgctgtgagtgtgcaccacgcattggcatccaaggccacggactatgagaagaaaccaaacgtgtttaaacttaaaactgccgactggagggtcttgctttttcaaactcagagcccagaggaaatgcaagggtggataaacaaaatcaattgtgtggcagctgtattttctgcaccaccatttccagcagcaatcggctctcagaagaagtttagccgcccacttctgcctgccactacaacaaaactgtctcaggaggagcaactgaagtcacatgaaagtaagctgaagcagatcaccaccgagctggccgagcaccgctcatatccccccgacaagaaggtcaaagccaaggacgtcgatgagtacaaactgaaagaccactatctggagtttgagaaaacccgctatgaaatgtatgtcagcattctcaaggaaggaggcaaagagctactgagtaacgatgaaagcgaggctgcaggactgaagaagtcgcactcgagtccttcgctgaacccggatacttctccaatcactgccaaagtcaagcgtaacgtgtcagagaggaaggatcaccgacctgaaacaccaagcattaagcaaaaagttacttagagtccatctgcggccaggaagtgctggtcatggagcaaaatagggtttttcaagatctttctggtaatccgtgaatatatttaaaaaaaaaaagtctgtgacaaaacggtgcattagtaattttttctattgtatatttttgttagtttctgtacagattgtctttgctcttgatttcttttgctttgatgatttttgcaacttgatagctaatgcaccttttctgtgaggaggaggggatcgtgatttcagaatgaattatgtatcccttctcttttggttttctcttgtttgcagtctgctcagttgttttatgtattctcatatcaactgttaaacttttttttaaggttaaagaatttaatccattgtgaaacacttaactggacaaactgtagttttagtaaattctagctggagttaatatacgcctttatatgtgaaatcttgcccagtcacagaggtagaattgagcactcacagatgctccagtaagaatcacagtgctgggaatctagttgctccaatatgaggcagcttcatgtgcagcttagcacttgttgttgagatcggaccctgctggaagcagggaaaagaagcgtgaagatcgtaggattgagaacttagggaagcacattagcttgcttgaagtgctgattccatttcagccaagcaagggaaagaggaagtggagtcattttgcctttgaaggctgaggaaagattgatacccagttaattttgtttgctaaaggatgggggcaataatcggcccttgaggagctgcagcagtaggcatgtgctcagtctgcaggaattgttacctcactcccacagggtctagactagaaatccatcatctctatcgttgatatccttccatccaggaatagatttttcttactctacatatgtgtgtgtgcgtgcgtgtgtgtgcgtgtgtgggcatggggttgtgtcctggttgtgatattgaggtcttccttcctaacaaattaatactaaaatgaaacagcttttcttgtgtccttaagacaaaataaggaaggaaaacgtagctgcagttgtccacgatggatattggttctttaaaatatatctgaaagtagtagtcagaatgaattatggttggaaaactgaggaatcttctggttgcaggtgcaaagtgactttgtttattcttgtctcagtctccttgatagccacttcactctgctactactcaactttctcctaaaaatacttcatctattttcagtcctttctttctgtctactcaaaatggttctattaactttgcagtcatgagcttgttccagttacagtccctttgaagttcagggtgataaacagaatattcttctgtagaggaagagaaaggagtgaaagtttagcccactgagacctagagctttgtgatttcctaaccttgaaactctgtaatccctaaagttaaaatctccgcaagtggcacaacttcagaactaatagtatcactttgatttttctttttcctcccttagaaagtttctctagttctatagtttatttgttgaaggtactatgaccaaagaatcagctgctctacaggaatagcatggttccagtgaattagagaaaacctgctgtaaagccatggtagtgtctaagtggtatgttattatgatgtactagcatttatttacagaattatttattaacgtttacttccttcccctctgtaaatgtccatgactattgcccagagaaggcttacccctctctagggttgcagttgctttctttgtaataagtattttgccacacctgtaaaaaaaaaaacctcacttttaactctctgccttgtttgggtaaaggcagtaactaagtttatgtttcagaactgcaaaacaaacaggatagttaccaatatggcccatgtatcagattgatttttgtagcctctcactgaatccaacatatccacaagcaagttatctgtctttctacctgataatctaaattatcaggatatttgttttctgcctaaatgtttatactaagccgaggggagagaggtacctagaccatgtcatctacaagcttcagtaactaaagaaaaaggaacttccctgagtggcttgaatgtgtttgcccacagtctatatctatgtatatagaatgtctgtatgtattttacttatttaatatacattgaatggtaccttgctacagtatttctgacatttagagtagtgttgaaatactcggctagcatcagcaccactatagcactgtccgtgtcatatgagtcactaatattaactccagggacttctggataggctaatagatcattggatacgaagggctcttttgaagcttcagtataccatgtttgcatagtttatctttaaaaacaactttaaaggttcttttgtgagccaggatctcagactgccgtagcatgatgctgtccatctttagcgcatgggctgagaacacctcttccctgaggcttctgaaggttgctgtctgtcatgagtgcatgaaggaggccaagagtttatgctatgggaggaaacagtcactgatttgcctagattctgagagtctggcccatagccaaccacattttcctttgggataatttatttcctgtggcatctagccagaagaaattgaggatgtttcctttcacagctgctccaagcctgttgcccaattcacggtacaagggagcaccccttccctttcctctgaaggtacgccacccacctccgtcgcccacctcagcgcccaggagccttgggacttccttccatatgataaatcattcttcttcacgtcaatacacttcatattaatttctagtacagaaaatcttgacagctatcagaatgccttggtcatagtgttgttgcaaaattgaccatacaggtggcccatgtataaaatctgaattttaggggtttgtccccacctcgcatgctggcttttacagggaggtgtctgggattcctcattagcaatcaaaacttaattactgggatgcagagtccttactttatcgccagcccgtaggcatttctgaagtgcacttttttgaaacatcattttgctaactctcagcagtgtctaattaaactgagcaatacttttgtgaattttaattaatctcagcaaaaccatgatgggagagagtcctctgatggaaatgtagtccctggattatgtgtaacctttttattcctcttagatgcagaggatagaaagcattttttggtgcagtggtcttgtggcaaacacaagaccctctatgcgtctccaactgttatcctaatctagaaaatgaggactggcccctgggcaaaagtgacatgaggaatttactctggaagaggaaaatctgggtggctttccaaggctaagataggtttgtatttcaccctgtggccaagctacagaacttctgagattgtggaagaatttttgcaaccagcagggaaagaggcctcttactgcctaaacacaaagttacactgagcttttctactgtcctttgcctattgctccctctatcatgtaaagatctgggaaggatgagaggcagggcctgcttgtcatgagctgcactcttttctttttaactaatcattgacaattggaagaaaattgacgttaaagaagtttctccattgtcttactaacaaaaccttttgggtttcattaattgtccttgaaattgagttcctttggcatttttccttgcagtcatcagttaagcatgttgcatcctgaattcacagaagtttagctttgcaggtttgaatctctgtaatttaactcccgtggacttggtcgagttttcagcaggttgggagccacctctcttcatttcagcagtgagtcatcccttgacttttcaaatgacagaattttttccaattgtaaaattagcactgtaaaacaaagaaccaaagtggcatcctaagagttgttaaacctgaagtctagtttatgaggaattgtccaagttggagtttaaatagtatctgcttttgtctcaaagcatctaagttattctgacagaaaatggtaagtcagctttgcaggcagatgcgcctctgggcctcctaccttgctccacagctttctggccatcttgtctcccaggccatgccactgctctgccacatgtcagcaaatttctttccaccagtcttatagcatcttacatgatcaaatcatcacagaataaccccgtgatagattattgatagcaatagagaggggctttgtcactgatttttctctcagattccttttccatctctcatccataaaggaaggactgaaatccaaaggcattctccttttgtacctacagtatccagaacccacgtgggcagccttctgcttatgacaataattggcccattgcatgcagagagaatgtcttcatagagagaatgtcattaaatacttgaatctgcatgacagtttgacttgaatgcaacagcaggaaaattttgcaagttacataattgtatatacagtaggttttcttaagtctcttcggttcatcctttgtaatttgtgtgtgtatctgtagtattgcaggcttttggagactattcttacaggcagtatgtcagtcatcaaagaaaatgctgtcacctgccattgttgtatttgtgggtatttatagttgtatgtatgtaaatgcatcagtgtgtagattgcatatcagtgtatggtacatgtacatcaaaattatttttgtccttaatcagtgtgatatgaaaagcaagtacaacctcataggactgattatataatgaagttgttgagagtatatatagtggtattgttttattaaacttaaactcaaataatattttgattaaaatttttaataagactttatgctagaaaattctttgagctttgaatcaccagggcaaaaatgactttcaactaaccttgtgaatcttttgcagtgtactgtgtgcaataccaagggcatagctccctgtaatttgggaaatacagaaagaaaagaaaaaaaaaaaaaaaggcagcctgtgcagtcttagtaactttagtattaagagcacttaaagtcaaactgacaattttgggcttattacaaaatgtgatgctttaaagcacacgttctttattgttgttgtaattagtccataaaaaatatagctttcggaagaattaagtacccaccatatcatttatgtatttgtgtatgttttacgggagatcaaaccactctcgtggtgccgcatccgtactcgcttgacttggaagaaatatcacaagcactaaagtatatcagggcatcccaggattgggtactgtatcctaggtttgcagttgcagaaattagcatctagtgtcacaggtaaaagaatttcaggaccaggtttaaactttattttaaatatttttatacttaggtctctttttcctgcctctccccaaagaagagccactggccttagttgtttgagcttactgcttatattatagagtgtaaataggtaactagagactaaaattttattaaccagcatgtttggtatatttaaagcagtgactgagtgtgtttgagtgagtggctgagtgcagtgtcttttgtttaaacacactgcctcgtgtctttgtagctgattcagagagtttgaattgtggggtgggagactaacttcagctccaggctgcagtaatgtgttggtagttacacttgaggcatttttttgttgttgttaattaactctatagtctcaaactatttttgcaaatatatcatttttcctaattggttcttgacgtgcagtggactggctctgtgaatgattggcagggtcttagttttgcgagagtatttccttctaagaattattgtgatctgcagaaacagccatttgattcaaaaatcatgtagaaaaggagtaggagaagcaaaacgtttcatttttgggccttaaccatttgaaatgtttggactttaaacataaagccatggagtttataaagccaagtaaccatttgatatggataataatatctactctagagagagtatatatatgcacattgatttttaatgctgttaagatacttttgtaaaactgtaggaacaagagtaattagaccaaattgaagcttaggggacagtaaagtggttgctttccatttagggtaaccatgcatgtggttagtcctctcctcctgagattcagaaccagttgactgtccccttaggtgtataaggagaaaagttgacatgtctgggacctctgacatgtgtacacatgcttgcacacatgcacacacagtgaatgttttaagttatacaaacataagaccttaagatgcaaagagccagaatattctaaagaggtgatgaacagagggggtggaaactgcatcacagatgttttccaagggccagggtggaatctgagctctagtgtctgactttgagatgcattatatttttaacacataaatgaggggatccatatcacattctttcttgtggaccaccaaattgaaggctttcttgtaattcacaagcagcagctctccagcatctctccgtagcctgggtgaagtcccagaagctggtgtgcatcattttccaaggtggcagagctgcttgctctgcagatcattcctttgagagaggagtacaagtgaagaaacaaggaggcacttcctgtaggagcactgatgtgccttgtccacactcccctctgagctttactggtaagagagctccgactgaacatgctgagcagttgagcacttttccatcagcaacaacagcgaggatggaaatggaaaggaaccgaactaaaatgcatttccctttgcagggcagagagctaagctcttaggaatagtgttatagaaataagcaccctaacttcaattcctgaaaatgttggttaatggagagaattttggagtttcacttaatattttcccatcggtcgccataaataagtcttcaggcgctcctagaagagtcccagcccaaggctcgattaaggaccacactgcaggtctgaggctcactgctctgagtcctgaacaccagagccctgcagagagtggtgataacacatcatctctgcaaagaggaacctctcccccggccgccacttcactcaggcttctactgagcagcaaggacagcctgggtttcaaatgccacttcccctgctttagggatccaggtgtcctgatagcgtgaccctgctgaggcaaggtatcaactccgagagtgactgagtcactgagcgtggcacatgaacaaacgtcatgacaaagattctctgagtgaagttaacaccacgtattttacctttgcaaaaaacaaactggcaccctgagttctaactacggacggacgatatctttgcctccacacccagattcctggaaatggctaacgtttcctttctaggggaagggtcgaggaatactcaagtgctagcttagcagctttgttcagtccagatcagagctgttaggtaaaggcctaaccacctccctgcagtctcttatatctcaagctttaggaacccatttctaaatgtacactagcggagaatttatattgtcagccttgattaccataggacaggcagaaaggcgataatttgtatcttttaatataaaagaagcttttaacttttccagcctattataataactgagttatattcactgtggctcaaactaattggcattgtggaacatttctttaccttcaaagttttctccaccaatcatttcagttctattgcagtcctggtgccatatgtcccctgcaaattgtgaaagtaattagtgacaaaatagcagcctgctccttttcaatggcgaaactgtcggcattagcagttttgggtaagctggcggtactataacacgtactggaaacctgttcctcatcaccacctaccagattctggaaatgccgtcttctagaaaacgatggcgtttgtggtggtcttcttttgaaaggaacagtaatttgtgtggatattgttaaagtgtttaaagaatattttgacaattaagtttacattttacaattgctttattttttattaaaatagttgtatataaatattaccctatttcactgttgttcaagtaaatctaaaccttgtagacaagtgagtcatctgatatgtatagaagctgtgatatatagagtacatttattgtgtaaatgtttatgaatataattgttcctgtgtttttataagttggggatattttgttgttttacggcaacaaaatttattgcatttaaatggtttttatgtaatagaaatcacgcaaaatagtgaaggatttaaaatatgtatatgatacatgtaaatgtacaaactttagaaagaaataaatccaacaaatttcaatca

SEQ ID NO: 4 - DNA, 3898 bp, Homo sapiens
ctcaaaaagattcctttccccctaagaggtactgagcctatagaaatactctgaatgtgagtgagtcaactgaattttaaggctgtcggtggaaccatggggctgagtcacgtctgcccacagctgctgctgttcgcatccctgggcactgaggcctgaaactccaccctggcagggaccagcccgacccccctggaggaaatggccgggcagtttcagcagcagcagatgaaaacttccttcctcttcatccagctgcgggctcctccagcctgcactctccccgccccgtctccagcggcaaccccagggggcctggaggagggacacagtttcccaagtcccaggacaggcctcttggcaggctgggacctcaggcgcacacagggctcagctgcccctcctttgaggctgctgcagaaggcaggccctgagacggaggaatcagctgctttcacttgctctgctccaaaggaaaagaaggaagggaggaaaaaatcccaggatccggacgtaagcaggggtggtgattgcagatccccacatcacaggcattgccaggcccctgcctccaagacactgggctggctacagcccctggcatggaggcttcctagcccagctcccatcatgagtgatgaaagcagcagtccctccatgggctggaagcactggccagtcacttctgccacccaggatctgtggggcatggacccccgatgcagggatgccttgggatgctcccctccaagggctgtcctggtccacgctgcagatggagcggaaaggactgtgctgaggagaggcgccgagacctgccaaatactccccaggagctgtaaggaggccacaggtaccacagcgcaggcgacaagggcatggctctacaggtactgtccagctgtgcacaccagcaagggctgcccagccccgcctgccactctgcctctcaaggcagagacatttgtttgggtgaacaatgcatctgcacattcccagagtgttgccaaggccaaatatgaatttttatttggcagatctgaagggaaagctccagatactagtgatcatggaggaagcactttactcccaccaaatgtcacaaatgaatttccagaatatgggaccatggaggaaggtggagaaggcctaagggcttctctggaatttgatggtgaggctctgccatgccacccacaagagcagcagggtgtccagcctcttactggctgccactctgggctcgacagtgttacagaaggaccaaaagatgtcagagaggccccctctcaaagtcatctcaaggaacaaagtttacagcccattgactctttgatttcagctctgaaagccacagaagccagaatcatttccggaacattacaggctacaaaggtactggaccaagatgctgtttctagtttttcagttcagcaggtggaaaaagagctggacactgccagtcgtaaaacacagagagtcaacaaaacgctccctgctggccaaaaaaatttaccagaaatacctctttcagctgaagtaacaacggaggaaagtttttatttgagcatccagaaagatctcaccgcgctgttaactggagacactcaggcagagatttcccagataatgaataatgggaggaaaggggctgtctgtgtgcaggagccatcttgtcctttggcctccctcgggagctcagcagtgacctgccactctgcaggcagtgttggtttcttgaaagagcagaggtctgctcttgggagagagcacccagggggatgtgatcgaagcagctccatgggacgcccaggccgggtcaaacatgtggaatttcaaggagtggaaatactgtggacaggaggagacaagagagagacccagcatcctatagattttgagacatcactgcaaagaacagcctctcctgacagcaaagagtcttccaaagtgccacgccatctcatctcatcagctggtttgtgtaattcaagtagtttaactgagaatgtttgggatgaatcctggaaagctccttcagagaggcctggcactagctcggggacattttcccctgtgcgtcttgatgagagtggagaggatgaagtcttcctacaggaaaacaaacagcatcttgagaagacacctaaaccagagagagacagggaaaggatcagcgaacaagaggagcacgttaagggggaagatgaagacatccttgggcctggatatacggaggactccaccgacgtgtacagctcccagtttgaaaccattttggacaacacttctttatactacagtgcagagtccctggagacattatactcagagcctgatagctattttagctttgaaatgcccctcactccaatgatacaacagcgcattaaagaaggtggtcagttcttggagaggacatcagggggaggacatcaggatatcctgagtgtgtctgcagatggtggcatcgtgatgggctattctagtggcgtcaccaatgggctgaatgatgccagcgactccatctacacgaaaggcaccccggagattgctttctggggaagcaatgctggggtgaaaacaacacggctagaagctcattctgaaatggggagcactgaaattttggaaaaggagaccccagaaaatctcagtaatggtaccagcagcaatgtggaagcagccaaaaggttggccaaacgcctttatcagctggacagattcaaaagatcagatgttgcaaaacaccttggcaagaacaacgaatttagcaaactagttgcagaagaatatctgaagttttttgattttacaggaatgacgctggatcagtcactcaggtatttctttaaagcattctctcttgtgggagaaactcaagaacgagagagagttttaatacacttctccaatagatatttttattgtaacccagataccattgcttcacaagatggagtccattgccttacctgtgcaataatgcttcttaataccgatctacatggccacaatattggaaagaagatgacctgtcaggagttcattgcaaatctgcaaggggtaaatgagggtgttgatttctccaaggatctgctgaaagagactgaggagctccttgggatgattgatgccctcctttcagcagaccagcaatgcaaggataagtggaactaccatggcaaatattctatcctgaacatgaaaacaatttgctgatcagactgtgctgtgtagtgacgaaatgttgatgccagaaggaactggagaggttatttcatccaacactcacatttcctggatgaggaatctaggacccctaaaaattgatagatacttgcccagaggtaattcacgcaatcacaggcagagctttgggaccttctggggattttaagataaaggaggagagaaggtgccatgttcttttcttagaactccatttaaagcattttgtttctttaagtaacaataatgttctagaatataaaatgttcccaagttgacttctgatagcaacgaaatgttttagtgaatcatggacctcagaccttaatactgtatataaaagaaacacttttctataatgttctgcagagcactcttgtttacatagactgtcaaggagatgggctccatatttaagagaaaatgttttgagtcttatcacttgtcaggtacttttgttggccagtcaggagtggatggtaaaagtactgacaattctcttatctcattcttagcccgttgtttcctaccctctcccccttgcctgtgatacccagtattgtcgccactcaccccatgtcgctgtcgagcagttaatacctggctagtccaaattgagatattctgggagtgtaaaatacacaccagatttcaaagactcgtgcag

SEQ ID NO: 5 - DNA, 3277 bp, Homo sapiens
catgactcaaaaagattcctttccccctaagaggtactgagcctatagaaatactctgaatgtgagtgagtcaactgaattttaaggctgtcggtggaaccatggggctgagtcacgtctgcccacagctgctgctgttcgcatccctgggcactgaggcctgaaactccaccctggcagggaccagcccgacccccctggaggaaatggccgggcagtttcagcagcagcagatgaaaacttccttcctcttcatccagctgcgggctcctccagcctgcactctccccgccccgtctccagcggcaaccccagggggcctggaggagggacacagtttcccaagtcccaggacaggcctcttggcaggctgggacctcaggcgcacacagggctcagctgcccctcctttgaggctgctgcagaaggcaggccctgagacggaggaatcagctgctttcacttgctctgctccaaaggaaaagaaggaagggaggaaaaaatcccaggatccggacgtaagcaggggtggtgattgcagatccccacatcacaggcattgccaggcccctgcctccaagacactgggctggctacagcccctggcatggaggcttcctagcccagctcccatcatgagtgatgaaagcagcagtccctccatgggctggaagcactggccagtcacttctgccacccaggatctgtggggcatggacccccgatgcagggatgccttgggatgctcccctccaagggctgtcctggtccacgctgcagatggagcggaaaggactgtgctgaggagaggcgccgagacctgccaaatactccccaggagctgtaaggaggccacaggtaccacagcgcaggcgacaagggcatggctctacaggtactgtccagctgtgcacaccagcaagggctgcccagccccgcctgccactctgcctctcaaggcagagacatttgtttgggtgaacaatgcatctgcacattcccagagtgttgccaaggccaaatatgaatttttatttggcagatctgaagggaaagctccagatactagtgatcatggaggaagcactttactcccaccaaatgtcacaaatgaatttccagaatatgggaccatggaggaaggtggagaaggcctaagggcttctctggaatttgatggtgaggctctgccatgccacccacaagagcagcagggtgtccagcctcttactggctgccactctgggctcgacagtgttacagaaggaccaaaagatgtcagagaggccccctctcaaagtcatctcaaggaacaaagtttacagcccattgactctttgatttcagctctgaaagccacagaagccagaatcatttccggaacattacaggctacaaaggtactggaccaagatgctgtttctagtttttcagttcagcaggtggaaaaagagctggacactgccagtcgtaaaacacagagagtcaacaaaacgctccctgctggccaaaaaaatttaccagaaatacctctttcagctgaagtaacaacggaggaaagtttttatttgagcatccagaaagatctcaccgcgctgttaactggagacactcaggcagagatttcccagataatgaataatgggaggaaaggggctgtctgtgtgcaggagccatcttgtcctttggcctccctcgggagctcagcagtgacctgccactctgcaggcagtgttggtttcttgaaagagcagaggtctgctcttgggagagagcacccagggggatgtgatcgaagcagctccatgggacgcccaggccgggtcaaacatgtggaatttcaaggagtggaaatactgtggacaggaggagacaagagagagacccagcatcctatagattttgagacatcactgcaaagaacagcctctcctgacagcaaagagtcttccaaagtgccacgccatctcatctcatcagctggtttgtgtaattcaagtagtttaactgagaatgtttgggatgaatcctggaaagctccttcagagaggcctggcactagctcggggacattttcccctgtgcgtcttgatgagagtggagaggatgaagtcttcctacaggaaaacaaacagcatcttgagaagacacctaaaccagagagagacagggaaaggatcagcgaacaagaggagcacgttaagggggaagatgaagacatccttgggcctggatatacggaggactccaccgacgtgtacagctcccagtttgaaaccattttggacaacacttctttatactacagtgcagagtccctggagacattatactcagagcctgatagctattttagctttgaaatgcccctcactccaatgatacaacagcgcattaaagaaggtggtcagttcttggagaggacatcagggggaggacatcaggatatcctgagtgtgtctgcagatggtggcatcgtgatgggctattctagtggcgtcaccaatgggctgaatgatgccagcgactccatctacacgaaaggcaccccggagattgctttctggggaagcaatgctggggtgaaaacaacacggctagaagctcattctgaaatggggagcactgaaattttggaaaaggagaccccagaaaatctcagtaatggtaccagcagcaatgtggaagcagccaaaaggttggccaaacgcctttatcagctggacagattcaaaagatcagatgttgcaaaacaccttggcaagaacaacgaatttagcaaactagttgcagaagaatatctgaagttttttgattttacaggaatgacgctggatcagtcactcaggtatttctttaaagcattctctcttgtgggagaaactcaagaacgagagagagttttaatacacttctccaatagatatttttattgtaacccagataccattgcttcacaagatggagtccattgccttacctgtgcaataatgcttcttaataccgatctacatggccacaatattggaaagaagatgacctgtcaggagttcattgcaaatctgcaaggggtaaatgagggtgttgatttctccaaggatctgctgaaacattttcaaaagattattcccaaaggactacacaagaggaagaagcagacctcagtcagaaaaaggagactgaggagctccttgggatgattgatgccctcctttcagcagaccagcaatgcaaggataagtggaactaccatggcaaatattctatcctgaacatg

SEQ ID NO: 6 - DNA, 7046 bp, Homo sapiens
catgactcaaaaagattcctttccccctaagaggtactgagcctatagaaatactctgaatgtgagtgagtcaactgaattttaaggctgtcggtggaaccatggggctgagtcacgtctgcccacagctgctgctgttcgcatccctgggcactgaggcctgaaactccaccctggcagggaccagcccgacccccctggaggaaatggccgggcagtttcagcagcagcagatgaaaacttccttcctcttcatccagctgcgggctcctccagcctgcactctccccgccccgtctccagcggcaaccccagggggcctggaggagggacacagtttcccaagtcccaggacaggcctcttggcaggctgggacctcaggcgcacacagggctcagctgcccctcctttgaggctgctgcagaaggcaggccctgagacggaggaatcagctgctttcacttgctctgctccaaaggaaaagaaggaagggaggaaaaaatcccaggatccggacgtaagcaggggtggtgattgcagatccccacatcacaggcattgccaggcccctgcctccaagacactgggctggctacagcccctggcatggaggcttcctagcccagctcccatcatgagtgatgaaagcagcagtccctccatgggctggaagcactggccagtcacttctgccacccaggatctgtggggcatggacccccgatgcagggatgccttgggatgctcccctccaagggctgtcctggtccacgctgcagatggagcggaaaggactgtgctgaggagaggcgccgagacctgccaaatactccccaggagctgtaaggaggccacaggtaccacagcgcaggcgacaagggcatggctctacaggtactgtccagctgtgcacaccagcaagggctgcccagccccgcctgccactctgcctctcaaggcagagacatttgtttgggtgaacaatgcatctgcacattcccagagtgttgccaaggccaaatatgaatttttatttggcagatctgaagggaaagctccagatactagtgatcatggaggaagcactttactcccaccaaatgtcacaaatgaatttccagaatatgggaccatggaggaaggtggagaaggcctaagggcttctctggaatttgatggtgaggctctgccatgccacccacaagagcagcagggtgtccagcctcttactggctgccactctgggctcgacagtgttacagaaggaccaaaagatgtcagagaggccccctctcaaagtcatctcaaggaacaaagtttacagcccattgactctttgatttcagctctgaaagccacagaagccagaatcatttccggaacattacaggctacaaaggtactggaccaagatgctgtttctagtttttcagttcagcaggtggaaaaagagctggacactgccagtcgtaaaacacagagagtcaacaaaacgctccctgctggccaaaaaaatttaccagaaatacctctttcagctgaagtaacaacggaggaaagtttttatttgagcatccagaaagatctcaccgcgctgttaactggagacactcaggcagagatttcccagataatgaataatgggaggaaaggggctgtctgtgtgcaggagccatcttgtcctttggcctccctcgggagctcagcagtgacctgccactctgcaggcagtgttggtttcttgaaagagcagaggtctgctcttgggagagagcacccagggggatgtgatcgaagcagctccatgggacgcccaggccgggtcaaacatgtggaatttcaaggagtggaaatactgtggacaggaggagacaagagagagacccagcatcctatagattttgagacatcactgcaaagaacagcctctcctgacagcaaagagtcttccaaagtgccacgccatctcatctcatcagctggtttgtgtaattcaagtagtttaactgagaatgtttgggatgaatcctggaaagctccttcagagaggcctggcactagctcggggacattttcccctgtgcgtcttgatgagagtggagaggatgaagtcttcctacaggaaaacaaacagcatcttgagaagacacctaaaccagagagagacagggaaaggatcagcgaacaagaggagcacgttaagggggaagatgaagacatccttgggcctggatatacggaggactccaccgacgtgtacagctcccagtttgaaaccattttggacaacacttctttatactacagtgcagagtccctggagacattatactcagagcctgatagctattttagctttgaaatgcccctcactccaatgatacaacagcgcattaaagaaggtggtcagttcttggagaggacatcagggggaggacatcaggatatcctgagtgtgtctgcagatggtggcatcgtgatgggctattctagtggcgtcaccaatgggctgaatgatgccagcgactccatctacacgaaaggcaccccggagattgctttctggggaagcaatgctggggtgaaaacaacacggctagaagctcattctgaaatggggagcactgaaattttggaaaaggagaccccagaaaatctcagtaatggtaccagcagcaatgtggaagcagccaaaaggttggccaaacgcctttatcagctggacagattcaaaagatcagatgttgcaaaacaccttggcaagaacaacgaatttagcaaactagttgcagaagaatatctgaagttttttgattttacaggaatgacgctggatcagtcactcaggtatttctttaaagcattctctcttgtgggagaaactcaagaacgagagagagttttaatacacttctccaatagatatttttattgtaacccagataccattgcttcacaagatggagtccattgccttacctgtgcaataatgcttcttaataccgatctacatggccacaatattggaaagaagatgacctgtcaggagttcattgcaaatctgcaaggggtaaatgagggtgttgatttctccaaggatctgctgaaaggaggcctcaggaaacctaaaatcgtggcagaaggggaggcaggcacatcttaagtggccggagcaggaggaagagaggaaggaaggagatgctgcacactgttaaataaccatagctcaggagagctcactcgtcatcatgagaacagcaccaaggggacagtgctaacccattcatgagagctccgccctcctgatccaatcacctcccaacagaccccacatccagtactacggattattattcaacatgagttttggtggggacacaaaccatgtcagatggccttttgaagtataggtaaaagacttgttatcttggttattattccattgcatttcctgccccttctttcacccaaagacattctcatatttacccctctcaactacatgaccaaatcaagacagtcattcatataacaaaataggccagatcatctggtatgattcacatagtacagataaacacagaaaaatttgctactgtcttacaagtttctgattaaccctgtgatcatgtttctactggctccacccatcccagcggttggatgtggtttgtattcaagcatccttggggacaatggaagagaaaggggaggttctgctttgggtctgatagattttgtaaaacattcgtaaggctctaataagtattacaggtactaacgacgtgaataaagagggataagaatgtagaatgcaggctagctctgtattgtaggctgtgttttgagagacagtacggtatgaggattgagattatgatttgagaactgtactgactgggttctaataccaggttctgtctcttaatagtcaggggactacgtcaagtaaatagtgtatttcaatatcctcatctataaaatgggagattttagagtcctcacatatagtaagtattgtctgttagctattaaaactttttatttttgatattattttacttagcctaaagtgggctggaaggaccctatcccttcctgcaggtatctggttttaagactttttagaggcgagtgagattagcggcagtagtcaaaacctctacccaccatccctttttagcttgctgctttccaaagatacatagcctctgctctttgaaaggaagcacctgtgacgttgactgaaaatgaatcttgcttaacccttacctttttaccttgttaacagcctctttctcctgggcctatccttcttcccacatttttaaacctgacgtttgatttgcgtttttagtgacttccctctttgatgctacaagaggggaagtactagggtgcattggctcttgaactggtcctggaatcttgaagaacctttgaggaagcaaactagttcatattctgctaagatcccaagattatcctggaatattgatggagatgtgaattacttgaagtgattaaaacatccctgggggagacaagggttgctagagatgtgccttcctaatggagaggcgttggtctgaaggatcaggtccaggaattgttgggattctgctttgtctcggggcaatttttatggactcttgactgtgtcagcctggggacttctttcacccagtcttatcagcggctgataccaactagtgaagtgttagcttttgattatgtgcatatttctgaaactcttcactctgtagaataacctttgaaaattcataacagcccagatacggaatcatcctaaatgttcatcagcagacgaatggataaaatgtggtagatatgcacagtggaatattatttggccttaaaaaggaggaattctgtcatttgtgacatcgataaatctggaggacgtttcactaaatgaaataagccaggcacagaaagacaaataccgcatgatctcacttacagtggaatctaaaaaagttgatctcacagattcatggagttaaatggtggttaccaggggtctggggatggtggggatttaaacaaagggtacaatttcctttcgactatataaataaatcatagagctttgttgtatagcatggtgactatagttaataacatcatattgtttgtttgaaaaatactaggagaatagattttgaatgttctcatcacaaaacagtatgtgaggtgagaaataggttaattagctttatttaatcattgtacagtatgtatgtgtactcaaaatactgcattgtgcaccacaaatatatacttttcatttgtcaattaaaacatttaaaaataagaattttcttgaaagttcctctatcttaatgttcaaaatgcagtgtcttgatcctctgcatttctgttccctgaattttatttctactgagtttcttaggaaacccttgttcttgtttgtaacagaaaagctgcgtttctatcttctatcgaatctgctctgcatttctaactctggtggttgataattgtccatttctcattatatacagaaaagacacagggcctttcagtgatggtcaccaggtatttatatatttagagatgaattgtccatttgaaaatgtatttacatgaaagaagggaagaaactgagaaataaatgacaagaagatcctggcaaatggtctaggaacataaagggtggaaggtcagttattggccgtcccataatttcattctgaagagacatctagactgtagattttgatatgacatgaacccaattgttttctatcccactttcccattgccatctaccatttaatactctgatactgctctccttagtatttttattccagtcattgttagatctttatttcttttttgagcagcagttaaattcagtaagtaccaagggagagtagaaagaaattagctgaaacagtctctcctttaaaaatttttataccaacttattgatggaaagaacagaaacaacaaaacaaaatgttccaaatatttgtgataaaactgaacacaatttgcagaatgtttaaaaacataccttgaatgtatttaaatacacaagtaggtctaagaataattctagttagaagacagtgtcactggaaatcatttaaaaacgtagggaaataaatcttacagataccaatcaatatgacagtcttttaggttattgcttgctattagatgtttgacattagaatattctttaaatttttaagtttttttatagaaattgctttacttgggaatttatgaactttgaaattagcacgtcttcccttaagggaagagcaaaagttttaatgtggaagaaagagagagagagagagagagagagtgtgtgtgtgtgtgaagaatgggttaaattgaaaggatgtaaatcagtatgcttggcctagcaggatttataagcttcactccatgaatggagtgataaaaaaacagtgaattaaattgttacatagtctgttggttagaattttaatgaaagttgtcattcaaatacatttgttttcccttgctttctcaaaggacagagtttaggcaagattctcttaggagacagttccaagaatatgtaggatacctccatcccgtttttaacctatcttgtcagctgaaaggattatatatgttgttttaaacataattttctcatttggttttcttaaggaaaaataatttgtgaaaatgatggagtaattagccaagaaggtagaatttaaacagactcaaaagatcagcaaagataaaacacattttaaataaagattaatgcatctttttggataaggaagaaacataattagaaaatataaagtgaggctctcagatttgtaaccattaggctttttaatcagttacagctgtatataagggtaaagaacaacagatgaatcagccattaaaaatctagagataagccatttttgtaagttcaaaccccaaaaaggatctgttcacacggagtgacagcaaaagctgtaatgattcttcttaaaaaaaaaaaaaaaaa

SEQ ID NO: 7 - DNA, 3253 bp, Homo sapiens
catgactcaaaaagattcctttccccctaagaggtactgagcctatagaaatactctgaatgtgagtgagtcaactgaattttaaggctgtcggtggaaccatggggctgagtcacgtctgcccacagctgctgctgttcgcatccctgggcactgaggcctgaaactccaccctggcagggaccagcccgacccccctggaggaaatggccgggcagtttcagcagcagcagatgaaaacttccttcctcttcatccagctgcgggctcctccagcctgcactctccccgccccgtctccagcggcaaccccagggggcctggaggagggacacagtttcccaagtcccaggacaggcctcttggcaggctgggacctcaggcgcacacagggctcagctgcccctcctttgaggctgctgcagaaggcaggccctgagacggaggaatcagctgctttcacttgctctgctccaaaggaaaagaaggaagggaggaaaaaatcccaggatccggacgtaagcaggggtggtgattgcagatccccacatcacaggcattgccaggcccctgcctccaagacactgggctggctacagcccctggcatggaggcttcctagcccagctcccatcatgagtgatgaaagcagcagtccctccatgggctggaagcactggccagtcacttctgccacccaggatctgtggggcatggacccccgatgcagggatgccttgggatgctcccctccaagggctgtcctggtccacgctgcagatggagcggaaaggactgtgctgaggagaggcgccgagacctgccaaatactccccaggagctgtaaggaggccacaggtaccacagcgcaggcgacaagggcatggctctacaggtactgtccagctgtgcacaccagcaagggctgcccagccccgcctgccactctgcctctcaaggcagagacatttgtttgggtgaacaatgcatctgcacattcccagagtgttgccaaggccaaatatgaatttttatttggcagatctgaagggaaagctccagatactagtgatcatggaggaagcactttactcccaccaaatgtcacaaatgaatttccagaatatgggaccatggaggaaggtggagaaggcctaagggcttctctggaatttgatggtgaggctctgccatgccacccacaagagcagcagggtgtccagcctcttactggctgccactctgggctcgacagtgttacagaaggaccaaaagatgtcagagaggccccctctcaaagtcatctcaaggaacaaagtttacagcccattgactctttgatttcagctctgaaagccacagaagccagaatcatttccggaacattacaggctacaaaggtactggaccaagatgctgtttctagtttttcagttcagcaggtggaaaaagagctggacactgccagtcgtaaaacacagagagtcaacaaaacgctccctgctggccaaaaaaatttaccagaaatacctctttcagctgaagtaacaacggaggaaagtttttatttgagcatccagaaagatctcaccgcgctgttaactggagacactcaggcagagatttcccagataatgaataatgggaggaaaggggctgtctgtgtgcaggagccatcttgtcctttggcctccctcgggagctcagcagtgacctgccactctgcaggcagtgttggtttcttgaaagagcagaggtctgctcttgggagagagcacccagggggatgtgatcgaagcagctccatgggacgcccaggccgggtcaaacatgtggaatttcaaggagtggaaatactgtggacaggaggagacaagagagagacccagcatcctatagattttgagacatcactgcaaagaacagcctctcctgacagcaaagagtcttccaaagtgccacgccatctcatctcatcagctggtttgtgtaattcaagtagtttaactgagaatgtttgggatgaatcctggaaagctccttcagagaggcctggcactagctcggggacattttcccctgtgcgtcttgatgagagtggagaggatgaagtcttcctacaggaaaacaaacagcatcttgagaagacacctaaaccagagagagacagggaaaggatcagcgaacaagaggagcacgttaagggggaagatgaagacatccttgggcctggatatacggaggactccaccgacgtgtacagctcccagtttgaaaccattttggacaacacttctttatactacagtgcagagtccctggagacattatactcagagcctgatagctattttagctttgaaatgcccctcactccaatgatacaacagcgcattaaagaaggtggtcagttcttggagaggacatcagggggaggacatcaggatatcctgagtgtgtctgcagatggtggcatcgtgatgggctattctagtggcgtcaccaatgggctgaatgatgccagcgactccatctacacgaaaggcaccccggagattgctttctggggaagcaatgctggggtgaaaacaacacggctagaagctcattctgaaatggggagcactgaaattttggaaaaggagaccccagaaaatctcagtaatggtaccagcagcaatgtggaagcagccaaaaggttggccaaacgcctttatcagctggacagattcaaaagatcagatgttgcaaaacaccttggcaagaacaacgaatttagcaaactagttgcagaagaatatctgaagttttttgattttacaggaatgacgctggatcagtcactcaggtatttctttaaagcattctctcttgtgggagaaactcaagaacgagagagagttttaatacacttctccaatagatatttttattgtaacccagataccattgcttcacaagatggagtccattgccttacctgtgcaataatgcttcttaataccgatctacatggccacaatattggaaagaagatgacctgtcaggagttcattgcaaatctgcaaggggtaaatgagggtgttgatttctccaaggatctgctgaaagtgttgtgggattggagaagatgctgaaaccaaatgggcacctgtcctcagagatcacagactactgagaaatattggaggtgtctttctccataaaataaacagttattccatgttgaaataaaagtataagccaaattctg

SEQ ID NO: 8 - DNA, 3800 bp, Homo sapiens
catgactcaaaaagattcctttccccctaagaggtactgagcctatagaaatactctgaatgtgagtgagtcaactgaattttaaggctgtcggtggaaccatggggctgagtcacgtctgcccacagctgctgctgttcgcatccctgggcactgaggcctgaaactccaccctggcagggaccagcccgacccccctggaggaaatggccgggcagtttcagcagcagcagatgaaaacttccttcctcttcatccagctgcgggctcctccagcctgcactctccccgccccgtctccagcggcaaccccagggggcctggaggagggacacagtttcccaagtcccaggacaggcctcttggcaggctgggacctcaggcgcacacagggctcagctgcccctcctttgaggctgctgcagaaggcaggccctgagacggaggaatcagctgctttcacttgctctgctccaaaggaaaagaaggaagggaggaaaaaatcccaggatccggacgtaagcaggggtggtgattgcagatccccacatcacaggcattgccaggcccctgcctccaagacactgggctggctacagcccctggcatggaggcttcctagcccagctcccatcatgagtgatgaaagcagcagtccctccatgggctggaagcactggccagtcacttctgccacccaggatctgtggggcatggacccccgatgcagggatgccttgggatgctcccctccaagggctgtcctggtccacgctgcagatggagcggaaaggactgtgctgaggagaggcgccgagacctgccaaatactccccaggagctgtaaggaggccacaggtaccacagcgcaggcgacaagggcatggctctacaggtactgtccagctgtgcacaccagcaagggctgcccagccccgcctgccactctgcctctcaaggcagagacatttgtttgggtgaacaatgcatctgcacattcccagagtgttgccaaggccaaatatgaatttttatttggcagatctgaagggaaagctccagatactagtgatcatggaggaagcactttactcccaccaaatgtcacaaatgaatttccagaatatgggaccatggaggaaggtggagaaggcctaagggcttctctggaatttgatggtgaggctctgccatgccacccacaagagcagcagggtgtccagcctcttactggctgccactctgggctcgacagtgttacagaaggaccaaaagatgtcagagaggccccctctcaaagtcatctcaaggaacaaagtttacagcccattgactctttgatttcagctctgaaagccacagaagccagaatcatttccggaacattacaggctacaaaggtactggaccaagatgctgtttctagtttttcagttcagcaggtggaaaaagagctggacactgccagtcgtaaaacacagagagtcaacaaaacgctccctgctggccaaaaaaatttaccagaaatacctctttcagctgaagtaacaacggaggaaagtttttatttgagcatccagaaagatctcaccgcgctgttaactggagacactcaggcagagatttcccagataatgaataatgggaggaaaggggctgtctgtgtgcaggagccatcttgtcctttggcctccctcgggagctcagcagtgacctgccactctgcaggcagtgttggtttcttgaaagagcagaggtctgctcttgggagagagcacccagggggatgtgatcgaagcagctccatgggacgcccaggccgggtcaaacatgtggaatttcaaggagtggaaatactgtggacaggaggagacaagagagagacccagcatcctatagattttgagacatcactgcaaagaacagcctctcctgacagcaaagagtcttccaaagtgccacgccatctcatctcatcagctggtttgtgtaattcaagtagtttaactgagaatgtttgggatgaatcctggaaagctccttcagagaggcctggcactagctcggggacattttcccctgtgcgtcttgatgagagtggagaggatgaagtcttcctacaggaaaacaaacagcatcttgagaagacacctaaaccagagagagacagggaaaggatcagcgaacaagaggagcacgttaagggggaagatgaagacatccttgggcctggatatacggaggactccaccgacgtgtacagctcccagtttgaaaccattttggacaacacttctttatactacagtgcagagtccctggagacattatactcagagcctgatagctattttagctttgaaatgcccctcactccaatgatacaacagcgcattaaagaaggtggtcagttcttggagaggacatcagggggaggacatcaggatatcctgagtgtgtctgcagatggtggcatcgtgatgggctattctagtggcgtcaccaatgggctgaatgatgccagcgactccatctacacgaaaggcaccccggagattgctttctggggaagcaatgctggggtgaaaacaacacggctagaagctcattctgaaatggggagcactgaaattttggaaaaggagaccccagaaaatctcagtaatggtaccagcagcaatgtggaagcagccaaaaggttggccaaacgcctttatcagctggacagattcaaaagatcagatgttgcaaaacaccttggcaagaacaacgaatttagcaaactagttgcagaagaatatctgaagttttttgattttacaggaatgacgctggatcagtcactcaggtatttctttaaagcattctctcttgtgggagaaactcaagaacgagagagagttttaatacacttctccaatagatatttttattgtaacccagataccattgcttcacaagatggagtccattgccttacctgtgcaataatgcttcttaataccgatctacatggccacaatattggaaagaagatgacctgtcaggagttcattgcaaatctgcaaggggtaaatgagggtgttgatttctccaaggatctgctgaaaaaaacaatttgctgatcagactgtgctgtgtagtgacgaaatgttgatgccagaaggaactggagaggttatttcatccaacactcacatttcctggatgaggaatctaggacccctaaaaattgatagatacttgcccagaggtaattcacgcaatcacaggcagagctttgggaccttctggggattttaagataaaggaggagagaaggtgccatgttcttttcttagaactccatttaaagcattttgtttctttaagtaacaataatgttctagaatataaaatgttcccaagttgacttctgatagcaacgaaatgttttagtgaatcatggacctcagaccttaatactgtatataaaagaaacacttttctataatgttctgcagagcactcttgtttacatagactgtcaaggagatgggctccatatttaagagaaaatgttttgagtcttatcacttgtcaggtacttttgttggccagtcaggagtggatggtaaaagtactgacaattctcttatctcattcttagcccgttgtttcctaccctctcccccttgcctgtgatacccagtattgtcgccactcaccccatgtcgctgtcgagcagttaatacctggctagtccaaattgagatattctgggagtgtaaaatacacaccagatttcaaagactcgtgca

SEQ ID NO: 9 - DNA, 12996 bp, Homo sapiens
catccatttaatggtgggcttgcatctttaaatacagggtgtgttttggggatcatgccattgtaattttatcacaaggaaaagatgttactgctcccgtagtgaagtgtctgtgaagctggttcagaagtgtgaagaatcattgtgcttcagaattcaaggagagctgagagataaatttgagtaacactttttatcaatagggaagctgaagcccaaacttgaagcatttgtgtgagactgcgtggtactatcgagccgagatttaagtctgatcacctgaccatcagtccagctgctaatgtttcatgttccatacttcttaaggagatttatgttcgtaaaaacaactgtgatgaagcaaaagaatatattttattcagttagtaatgccaaaggaaatagtagtctgaattctgtgggtctgtcattaatctgattgttttaacaatacagttttcaaagacctgcattaattattggagagatcagtaaaaatttataagccttgctatgggaagaggatgtatcaataggggctcacagcttcaagaataactaattgtttggtaagaataaccccccagtgcaggtggagctgagaaaccaaaggagaaggcagacaggtccagactgttgttatagggtgttttattggggaactgacagacagaagcgtggtttttggcaactgcaagacggatagatctccatgccattataccccagacccagggattatatctagggaaggggcacacatgcttcggagggaataggtaggaatttgatgtaagggcaggatttactgtaagtatgtgccattactcaagaaacagtagataaattggaaatctcagaggcattcccagaactggggttaatcagaagtcaacatggcatgttagtttccaagatagagttactttagcctccacacaaatgcaagcagaatgaattttatattatttagcaaggtggagtatgttaatggagcactttattaagcagagccctttagtgaattttacttctaggtcgagcagtcccttttaaaaaatgtttcacttttgtgatagtctgagcgtactttgaacacggcttcattcggaagctttagcgccttcaagccttgctcctcaaagctggtctgtggatcatggtcaccagggaacttttaggaatgcggagtcccaggccccaccttaacctgctcagtttctgttttaagaagattccaggtgattcgtatatacaacagagtacgaagaccattggtcgagagcagtggttcacaaagaagatggctcctgtaccagcaacatcagcatcacctgaaaaattgttagaaaatgcagattcgcaggccccacagacctacggcatcagaaactctgggatggaccccagcagtacgtgttttacttggtgctgcagagacatttgtttgggtgaacaatgcatctgcacattcccagagtgttgccaaggccaaatatgaatttttatttggcagatctgaagggaaagctccagatactagtgatcatggaggaagcactttactcccaccaaatgtcacaaatgaatttccagaatatgggaccatggaggaaggtggagaaggcctaagggcttctctggaatttgatggtgaggctctgccatgccacccacaagagcagcagggtgtccagcctcttactggctgccactctgggctcgacagtgttacagaaggaccaaaagatgtcagagaggccccctctcaaagtcatctcaaggaacaaagtttacagcccattgactctttgatttcagctctgaaagccacagaagccagaatcatttccggaacattacaggctacaaaggtactggaccaagatgctgtttctagtttttcagttcagcaggtggaaaaagagctggacactgccagtcgtaaaacacagagagtcaacaaaacgctccctgctggccaaaaaaatttaccagaaatacctctttcagctgaagtaacaacggaggaaagtttttatttgagcatccagaaagatctcaccgcgctgttaactggagacactcaggcagagatttcccagataatgaataatgggaggaaaggggctgtctgtgtgcaggagccatcttgtcctttggcctccctcgggagctcagcagtgacctgccactctgcaggcagtgttggtttcttgaaagagcagaggtctgctcttgggagagagcacccagggggatgtgatcgaagcagctccatgggacgcccaggccgggtcaaacatgtggaatttcaaggagtggaaatactgtggacaggaggagacaagagagagacccagcatcctatagattttgagacatcactgcaaagaacagcctctcctgacagcaaagagtcttccaaagtgccacgccatctcatctcatcagctggtttgtgtaattcaagtagtttaactgagaatgtttgggatgaatcctggaaagctccttcagagaggcctggcactagctcggggacattttcccctgtgcgtcttgatgagagtggagaggatgaagtcttcctacaggaaaacaaacagcatcttgagaagacacctaaaccagagagagacagggaaaggatcagcgaacaagaggagcacgttaagggggaagatgaagacatccttgggcctggatatacggaggactccaccgacgtgtacagctcccagtttgaaaccattttggacaacacttctttatactacagtgcagagtccctggagacattatactcagagcctgatagctattttagctttgaaatgcccctcactccaatgatacaacagcgcattaaagaaggtggtcagttcttggagaggacatcagggggaggacatcaggatatcctgagtgtgtctgcagatggtggcatcgtgatgggctattctagtggcgtcaccaatgggctgaatgatgccagcgactccatctacacgaaaggcaccccggagattgctttctggggaagcaatgctggggtgaaaacaacacggctagaagctcattctgaaatggggagcactgaaattttggaaaaggagaccccagaaaatctcagtaatggtaccagcagcaatgtggaagcagccaaaaggttggccaaacgcctttatcagctggacagattcaaaagatcagatgttgcaaaacaccttggcaagaacaacgaatttagcaaactagttgcagaagaatatctgaagttttttgattttacaggaatgacgctggatcagtcactcaggtatttctttaaagcattctctcttgtgggagaaactcaagaacgagagagagttttaatacacttctccaatagatatttttattgtaacccagataccattgcttcacaagatggagtccattgccttacctgtgcaataatgcttcttaataccgatctacatggccacaatattggaaagaagatgacctgtcaggagttcattgcaaatctgcaaggggtaaatgagggtgttgatttctccaaggatctgctgaaagctctgtacaactcaatcaagaatgagaagcttgaatgggcagtagatgatgaagagaaaaaaaagtctccctcagaaagtactgaggagaaagctaacggaacacatccaaagaccatcagtcgtattggaagtactactaacccatttttggacattcctcatgatccaaatgctgctgtgtacaaaagtggattcttggctcggaaaattcatgcagatatggatggaaagaagactccaagaggaaaacgaggatggaaaaccttttatgctgtactgaagggaacagttctttacttgcaaaaggatgaatacaagccagaaaaggccttgtctgaagaggacttgaaaaacgctgtgagtgtgcaccacgcattggcatccaaggccacggactatgagaagaaaccaaacgtgtttaaacttaaaactgccgactggagggtcttgctttttcaaactcagagcccagaggaaatgcaagggtggataaacaaaatcaattgtgtggcagctgtattttctgcaccaccatttccagcagcaatcggctctcagaagaagtttagccgcccacttctgcctgccactacaacaaaactgtctcaggaggagcaactgaagtcacatgaaagtaagctgaagcagatcaccaccgagctggccgagcaccgctcatatccccccgacaagaaggtcaaagccaaggacgtcgatgagtacaaactgaaagaccactatctggagtttgagaaaacccgctatgaaatgtatgtcagcattctcaaggaaggaggcaaagagctactgagtaacgatgaaagcgaggctgcaggactgaagaagtcgcactcgagtccttcgctgaacccggatacttctccaatcactgccaaagtcaagcgtaacgtgtcagagaggaaggatcaccgacctgaaacaccaagcattaagcaaaaagttacttagagtccatctgcggccaggaagtgctggtcatggagcaaaatagggtttttcaagatctttctggtaatccgtgaatatatttaaaaaaaaaaagtctgtgacaaaacggtgcattagtaattttttctattgtatatttttgttagtttctgtacagattgtctttgctcttgatttcttttgctttgatgatttttgcaacttgatagctaatgcaccttttctgtgaggaggaggggatcgtgatttcagaatgaattatgtatcccttctcttttggttttctcttgtttgcagtctgctcagttgttttatgtattctcatatcaactgttaaacttttttttaaggttaaagaatttaatccattgtgaaacacttaactggacaaactgtagttttagtaaattctagctggagttaatatacgcctttatatgtgaaatcttgcccagtcacagaggtagaattgagcactcacagatgctccagtaagaatcacagtgctgggaatctagttgctccaatatgaggcagcttcatgtgcagcttagcacttgttgttgagatcggaccctgctggaagcagggaaaagaagcgtgaagatcgtaggattgagaacttagggaagcacattagcttgcttgaagtgctgattccatttcagccaagcaagggaaagaggaagtggagtcattttgcctttgaaggctgaggaaagattgatacccagttaattttgtttgctaaaggatgggggcaataatcggcccttgaggagctgcagcagtaggcatgtgctcagtctgcaggaattgttacctcactcccacagggtctagactagaaatccatcatctctatcgttgatatccttccatccaggaatagatttttcttactctacatatgtgtgtgtgcgtgcgtgtgtgtgcgtgtgtgggcatggggttgtgtcctggttgtgatattgaggtcttccttcctaacaaattaatactaaaatgaaacagcttttcttgtgtccttaagacaaaataaggaaggaaaacgtagctgcagttgtccacgatggatattggttctttaaaatatatctgaaagtagtagtcagaatgaattatggttggaaaactgaggaatcttctggttgcaggtgcaaagtgactttgtttattcttgtctcagtctccttgatagccacttcactctgctactactcaactttctcctaaaaatacttcatctattttcagtcctttctttctgtctactcaaaatggttctattaactttgcagtcatgagcttgttccagttacagtccctttgaagttcagggtgataaacagaatattcttctgtagaggaagagaaaggagtgaaagtttagcccactgagacctagagctttgtgatttcctaaccttgaaactctgtaatccctaaagttaaaatctccgcaagtggcacaacttcagaactaatagtatcactttgatttttctttttcctcccttagaaagtttctctagttctatagtttatttgttgaaggtactatgaccaaagaatcagctgctctacaggaatagcatggttccagtgaattagagaaaacctgctgtaaagccatggtagtgtctaagtggtatgttattatgatgtactagcatttatttacagaattatttattaacgtttacttccttcccctctgtaaatgtccatgactattgcccagagaaggcttacccctctctagggttgcagttgctttctttgtaataagtattttgccacacctgtaaaaaaaaaaacctcacttttaactctctgccttgtttgggtaaaggcagtaactaagtttatgtttcagaactgcaaaacaaacaggatagttaccaatatggcccatgtatcagattgatttttgtagcctctcactgaatccaacatatccacaagcaagttatctgtctttctacctgataatctaaattatcaggatatttgttttctgcctaaatgtttatactaagccgaggggagagaggtacctagaccatgtcatctacaagcttcagtaactaaagaaaaaggaacttccctgagtggcttgaatgtgtttgcccacagtctatatctatgtatatagaatgtctgtatgtattttacttatttaatatacattgaatggtaccttgctacagtatttctgacatttagagtagtgttgaaatactcggctagcatcagcaccactatagcactgtccgtgtcatatgagtcactaatattaactccagggacttctggataggctaatagatcattggatacgaagggctcttttgaagcttcagtataccatgtttgcatagtttatctttaaaaacaactttaaaggttcttttgtgagccaggatctcagactgccgtagcatgatgctgtccatctttagcgcatgggctgagaacacctcttccctgaggcttctgaaggttgctgtctgtcatgagtgcatgaaggaggccaagagtttatgctatgggaggaaacagtcactgatttgcctagattctgagagtctggcccatagccaaccacattttcctttgggataatttatttcctgtggcatctagccagaagaaattgaggatgtttcctttcacagctgctccaagcctgttgcccaattcacggtacaagggagcaccccttccctttcctctgaaggtacgccacccacctccgtcgcccacctcagcgcccaggagccttgggacttccttccatatgataaatcattcttcttcacgtcaatacacttcatattaatttctagtacagaaaatcttgacagctatcagaatgccttggtcatagtgttgttgcaaaattgaccatacaggtggcccatgtataaaatctgaattttaggggtttgtccccacctcgcatgctggcttttacagggaggtgtctgggattcctcattagcaatcaaaacttaattactgggatgcagagtccttactttatcgccagcccgtaggcatttctgaagtgcacttttttgaaacatcattttgctaactctcagcagtgtctaattaaactgagcaatacttttgtgaattttaattaatctcagcaaaaccatgatgggagagagtcctctgatggaaatgtagtccctggattatgtgtaacctttttattcctcttagatgcagaggatagaaagcattttttggtgcagtggtcttgtggcaaacacaagaccctctatgcgtctccaactgttatcctaatctagaaaatgaggactggcccctgggcaaaagtgacatgaggaatttactctggaagaggaaaatctgggtggctttccaaggctaagataggtttgtatttcaccctgtggccaagctacagaacttctgagattgtggaagaatttttgcaaccagcagggaaagaggcctcttactgcctaaacacaaagttacactgagcttttctactgtcctttgcctattgctccctctatcatgtaaagatctgggaaggatgagaggcagggcctgcttgtcatgagctgcactcttttctttttaactaatcattgacaattggaagaaaattgacgttaaagaagtttctccattgtcttactaacaaaaccttttgggtttcattaattgtccttgaaattgagttcctttggcatttttccttgcagtcatcagttaagcatgttgcatcctgaattcacagaagtttagctttgcaggtttgaatctctgtaatttaactcccgtggacttggtcgagttttcagcaggttgggagccacctctcttcatttcagcagtgagtcatcccttgacttttcaaatgacagaattttttccaattgtaaaattagcactgtaaaacaaagaaccaaagtggcatcctaagagttgttaaacctgaagtctagtttatgaggaattgtccaagttggagtttaaatagtatctgcttttgtctcaaagcatctaagttattctgacagaaaatggtaagtcagctttgcaggcagatgcgcctctgggcctcctaccttgctccacagctttctggccatcttgtctcccaggccatgccactgctctgccacatgtcagcaaatttctttccaccagtcttatagcatcttacatgatcaaatcatcacagaataaccccgtgatagattattgatagcaatagagaggggctttgtcactgatttttctctcagattccttttccatctctcatccataaaggaaggactgaaatccaaaggcattctccttttgtacctacagtatccagaacccacgtgggcagccttctgcttatgacaataattggcccattgcatgcagagagaatgtcttcatagagagaatgtcattaaatacttgaatctgcatgacagtttgacttgaatgcaacagcaggaaaattttgcaagttacataattgtatatacagtaggttttcttaagtctcttcggttcatcctttgtaatttgtgtgtgtatctgtagtattgcaggcttttggagactattcttacaggcagtatgtcagtcatcaaagaaaatgctgtcacctgccattgttgtatttgtgggtatttatagttgtatgtatgtaaatgcatcagtgtgtagattgcatatcagtgtatggtacatgtacatcaaaattatttttgtccttaatcagtgtgatatgaaaagcaagtacaacctcataggactgattatataatgaagttgttgagagtatatatagtggtattgttttattaaacttaaactcaaataatattttgattaaaatttttaataagactttatgctagaaaattctttgagctttgaatcaccagggcaaaaatgactttcaactaaccttgtgaatcttttgcagtgtactgtgtgcaataccaagggcatagctccctgtaatttgggaaatacagaaagaaaagaaaaaaaaaaaaaaaggcagcctgtgcagtcttagtaactttagtattaagagcacttaaagtcaaactgacaattttgggcttattacaaaatgtgatgctttaaagcacacgttctttattgttgttgtaattagtccataaaaaatatagctttcggaagaattaagtacccaccatatcatttatgtatttgtgtatgttttacgggagatcaaaccactctcgtggtgccgcatccgtactcgcttgacttggaagaaatatcacaagcactaaagtatatcagggcatcccaggattgggtactgtatcctaggtttgcagttgcagaaattagcatctagtgtcacaggtaaaagaatttcaggaccaggtttaaactttattttaaatatttttatacttaggtctctttttcctgcctctccccaaagaagagccactggccttagttgtttgagcttactgcttatattatagagtgtaaataggtaactagagactaaaattttattaaccagcatgtttggtatatttaaagcagtgactgagtgtgtttgagtgagtggctgagtgcagtgtcttttgtttaaacacactgcctcgtgtctttgtagctgattcagagagtttgaattgtggggtgggagactaacttcagctccaggctgcagtaatgtgttggtagttacacttgaggcatttttttgttgttgttaattaactctatagtctcaaactatttttgcaaatatatcatttttcctaattggttcttgacgtgcagtggactggctctgtgaatgattggcagggtcttagttttgcgagagtatttccttctaagaattattgtgatctgcagaaacagccatttgattcaaaaatcatgtagaaaaggagtaggagaagcaaaacgtttcatttttgggccttaaccatttgaaatgtttggactttaaacataaagccatggagtttataaagccaagtaaccatttgatatggataataatatctactctagagagagtatatatatgcacattgatttttaatgctgttaagatacttttgtaaaactgtaggaacaagagtaattagaccaaattgaagcttaggggacagtaaagtggttgctttccatttagggtaaccatgcatgtggttagtcctctcctcctgagattcagaaccagttgactgtccccttaggtgtataaggagaaaagttgacatgtctgggacctctgacatgtgtacacatgcttgcacacatgcacacacagtgaatgttttaagttatacaaacataagaccttaagatgcaaagagccagaatattctaaagaggtgatgaacagagggggtggaaactgcatcacagatgttttccaagggccagggtggaatctgagctctagtgtctgactttgagatgcattatatttttaacacataaatgaggggatccatatcacattctttcttgtggaccaccaaattgaaggctttcttgtaattcacaagcagcagctctccagcatctctccgtagcctgggtgaagtcccagaagctggtgtgcatcattttccaaggtggcagagctgcttgctctgcagatcattcctttgagagaggagtacaagtgaagaaacaaggaggcacttcctgtaggagcactgatgtgccttgtccacactcccctctgagctttactggtaagagagctccgactgaacatgctgagcagttgagcacttttccatcagcaacaacagcgaggatggaaatggaaaggaaccgaactaaaatgcatttccctttgcagggcagagagctaagctcttaggaatagtgttatagaaataagcaccctaacttcaattcctgaaaatgttggttaatggagagaattttggagtttcacttaatattttcccatcggtcgccataaataagtcttcaggcgctcctagaagagtcccagcccaaggctcgattaaggaccacactgcaggtctgaggctcactgctctgagtcctgaacaccagagccctgcagagagtggtgataacacatcatctctgcaaagaggaacctctcccccggccgccacttcactcaggcttctactgagcagcaaggacagcctgggtttcaaatgccacttcccctgctttagggatccaggtgtcctgatagcgtgaccctgctgaggcaaggtatcaactccgagagtgactgagtcactgagcgtggcacatgaacaaacgtcatgacaaagattctctgagtgaagttaacaccacgtattttacctttgcaaaaaacaaactggcaccctgagttctaactacggacggacgatatctttgcctccacacccagattcctggaaatggctaacgtttcctttctaggggaagggtcgaggaatactcaagtgctagcttagcagctttgttcagtccagatcagagctgttaggtaaaggcctaaccacctccctgcagtctcttatatctcaagctttaggaacccatttctaaatgtacactagcggagaatttatattgtcagccttgattaccataggacaggcagaaaggcgataatttgtatcttttaatataaaagaagcttttaacttttccagcctattataataactgagttatattcactgtggctcaaactaattggcattgtggaacatttctttaccttcaaagttttctccaccaatcatttcagttctattgcagtcctggtgccatatgtcccctgcaaattgtgaaagtaattagtgacaaaatagcagcctgctccttttcaatggcgaaactgtcggcattagcagttttgggtaagctggcggtactataacacgtactggaaacctgttcctcatcaccacctaccagattctggaaatgccgtcttctagaaaacgatggcgtttgtggtggtcttcttttgaaaggaacagtaatttgtgtggatattgttaaagtgtttaaagaatattttgacaattaagtttacattttacaattgctttattttttattaaaatagttgtatataaatattaccctatttcactgttgttcaagtaaatctaaaccttgtagacaagtgagtcatctgatatgtatagaagctgtgatatatagagtacatttattgtgtaaatgtttatgaatataattgttcctgtgtttttataagttggggatattttgttgttttacggcaacaaaatttattgcatttaaatggtttttatgtaatagaaatcacgcaaaatagtgaaggatttaaaatatgtatatgatacatgtaaatgtacaaactttagaaagaaataaatccaacaaatttcaatca

SEQ ID NO: 10 - DNA, 12974 bp, Homo sapiens
atccatttaatggtgggcttgcatctttaaatacagggtgtgttttggggatcatgccattgtaattttatcacaaggaaaagatgttactgctcccgtagtgaagtgtctgtgaagctggttcagaagtgtgaagaatcattgtgcttcagaattcaaggagagctgagagataaatttgagtaacactttttatcaatagggaagctgaagcccaaacttgaagcatttgtgtgagactgcgtggtactatcgagccgagatttaagtctgatcacctgaccatcagtccagctgctaatgtttcatgttccatacttcttaaggagatttatgttcgtaaaaacaactgtgatgaagcaaaagaatatattttattcagttagtaatgccaaaggaaatagtagtctgaattctgtgggtctgtcattaatctgattgttttaacaatacagttttcaaagacctgcattaattattggagagatcagtaaaaatttataagccttgctatgggaagaggatgtatcaataggggctcacagcttcaagaataactaattgtttggtaagaataaccccccagtgcaggtggagctgagaaaccaaaggagaaggcagacaggtccagactgttgttatagggtgttttattggggaactgacagacagaagcgtggtttttggcaactgcaagacggatagatctccatgccattataccccagacccagggattatatctagggaaggggcacacatgcttcggagggaataggtaggaatttgatgtaagggcaggatttactgtaagtatgtgccattactcaagaaacagtagataaattggaaatctcagaggcattcccagaactggggttaatcagaagtcaacatggcatgttagtttccaagatagagttactttagcctccacacaaatgcaagcagaatgaattttatattatttagcaaggtggagtatgttaatggagcactttattaagcagagccctttagtgaattttacttctaggtcgagcagtcccttttaaaaaatgtttcacttttgtgatagtctgagcgtactttgaacacggcttcattcggaagctttagcgccttcaagccttgctcctcaaagctggtctgtggatcatggtcaccagggaacttttaggaatgcggagtcccaggccccaccttaacctgctcagtttctgttttaagaagattccaggtgattcgtatatacaacagagtacgaagaccattggtcgagagcagtggttcacaaagaagatggctcctgtaccagcaacatcagcatcacctgaaaaattgttagaaaatgcagattcgcaggccccacagacctacggcatcagaaactctgggatggaccccagcagcagagacatttgtttgggtgaacaatgcatctgcacattcccagagtgttgccaaggccaaatatgaatttttatttggcagatctgaagggaaagctccagatactagtgatcatggaggaagcactttactcccaccaaatgtcacaaatgaatttccagaatatgggaccatggaggaaggtggagaaggcctaagggcttctctggaatttgatggtgaggctctgccatgccacccacaagagcagcagggtgtccagcctcttactggctgccactctgggctcgacagtgttacagaaggaccaaaagatgtcagagaggccccctctcaaagtcatctcaaggaacaaagtttacagcccattgactctttgatttcagctctgaaagccacagaagccagaatcatttccggaacattacaggctacaaaggtactggaccaagatgctgtttctagtttttcagttcagcaggtggaaaaagagctggacactgccagtcgtaaaacacagagagtcaacaaaacgctccctgctggccaaaaaaatttaccagaaatacctctttcagctgaagtaacaacggaggaaagtttttatttgagcatccagaaagatctcaccgcgctgttaactggagacactcaggcagagatttcccagataatgaataatgggaggaaaggggctgtctgtgtgcaggagccatcttgtcctttggcctccctcgggagctcagcagtgacctgccactctgcaggcagtgttggtttcttgaaagagcagaggtctgctcttgggagagagcacccagggggatgtgatcgaagcagctccatgggacgcccaggccgggtcaaacatgtggaatttcaaggagtggaaatactgtggacaggaggagacaagagagagacccagcatcctatagattttgagacatcactgcaaagaacagcctctcctgacagcaaagagtcttccaaagtgccacgccatctcatctcatcagctggtttgtgtaattcaagtagtttaactgagaatgtttgggatgaatcctggaaagctccttcagagaggcctggcactagctcggggacattttcccctgtgcgtcttgatgagagtggagaggatgaagtcttcctacaggaaaacaaacagcatcttgagaagacacctaaaccagagagagacagggaaaggatcagcgaacaagaggagcacgttaagggggaagatgaagacatccttgggcctggatatacggaggactccaccgacgtgtacagctcccagtttgaaaccattttggacaacacttctttatactacagtgcagagtccctggagacattatactcagagcctgatagctattttagctttgaaatgcccctcactccaatgatacaacagcgcattaaagaaggtggtcagttcttggagaggacatcagggggaggacatcaggatatcctgagtgtgtctgcagatggtggcatcgtgatgggctattctagtggcgtcaccaatgggctgaatgatgccagcgactccatctacacgaaaggcaccccggagattgctttctggggaagcaatgctggggtgaaaacaacacggctagaagctcattctgaaatggggagcactgaaattttggaaaaggagaccccagaaaatctcagtaatggtaccagcagcaatgtggaagcagccaaaaggttggccaaacgcctttatcagctggacagattcaaaagatcagatgttgcaaaacaccttggcaagaacaacgaatttagcaaactagttgcagaagaatatctgaagttttttgattttacaggaatgacgctggatcagtcactcaggtatttctttaaagcattctctcttgtgggagaaactcaagaacgagagagagttttaatacacttctccaatagatatttttattgtaacccagataccattgcttcacaagatggagtccattgccttacctgtgcaataatgcttcttaataccgatctacatggccacaatattggaaagaagatgacctgtcaggagttcattgcaaatctgcaaggggtaaatgagggtgttgatttctccaaggatctgctgaaagctctgtacaactcaatcaagaatgagaagcttgaatgggcagtagatgatgaagagaaaaaaaagtctccctcagaaagtactgaggagaaagctaacggaacacatccaaagaccatcagtcgtattggaagtactactaacccatttttggacattcctcatgatccaaatgctgctgtgtacaaaagtggattcttggctcggaaaattcatgcagatatggatggaaagaagactccaagaggaaaacgaggatggaaaaccttttatgctgtactgaagggaacagttctttacttgcaaaaggatgaatacaagccagaaaaggccttgtctgaagaggacttgaaaaacgctgtgagtgtgcaccacgcattggcatccaaggccacggactatgagaagaaaccaaacgtgtttaaacttaaaactgccgactggagggtcttgctttttcaaactcagagcccagaggaaatgcaagggtggataaacaaaatcaattgtgtggcagctgtattttctgcaccaccatttccagcagcaatcggctctcagaagaagtttagccgcccacttctgcctgccactacaacaaaactgtctcaggaggagcaactgaagtcacatgaaagtaagctgaagcagatcaccaccgagctggccgagcaccgctcatatccccccgacaagaaggtcaaagccaaggacgtcgatgagtacaaactgaaagaccactatctggagtttgagaaaacccgctatgaaatgtatgtcagcattctcaaggaaggaggcaaagagctactgagtaacgatgaaagcgaggctgcaggactgaagaagtcgcactcgagtccttcgctgaacccggatacttctccaatcactgccaaagtcaagcgtaacgtgtcagagaggaaggatcaccgacctgaaacaccaagcattaagcaaaaagttacttagagtccatctgcggccaggaagtgctggtcatggagcaaaatagggtttttcaagatctttctggtaatccgtgaatatatttaaaaaaaaaaagtctgtgacaaaacggtgcattagtaattttttctattgtatatttttgttagtttctgtacagattgtctttgctcttgatttcttttgctttgatgatttttgcaacttgatagctaatgcaccttttctgtgaggaggaggggatcgtgatttcagaatgaattatgtatcccttctcttttggttttctcttgtttgcagtctgctcagttgttttatgtattctcatatcaactgttaaacttttttttaaggttaaagaatttaatccattgtgaaacacttaactggacaaactgtagttttagtaaattctagctggagttaatatacgcctttatatgtgaaatcttgcccagtcacagaggtagaattgagcactcacagatgctccagtaagaatcacagtgctgggaatctagttgctccaatatgaggcagcttcatgtgcagcttagcacttgttgttgagatcggaccctgctggaagcagggaaaagaagcgtgaagatcgtaggattgagaacttagggaagcacattagcttgcttgaagtgctgattccatttcagccaagcaagggaaagaggaagtggagtcattttgcctttgaaggctgaggaaagattgatacccagttaattttgtttgctaaaggatgggggcaataatcggcccttgaggagctgcagcagtaggcatgtgctcagtctgcaggaattgttacctcactcccacagggtctagactagaaatccatcatctctatcgttgatatccttccatccaggaatagatttttcttactctacatatgtgtgtgtgcgtgcgtgtgtgtgcgtgtgtgggcatggggttgtgtcctggttgtgatattgaggtcttccttcctaacaaattaatactaaaatgaaacagcttttcttgtgtccttaagacaaaataaggaaggaaaacgtagctgcagttgtccacgatggatattggttctttaaaatatatctgaaagtagtagtcagaatgaattatggttggaaaactgaggaatcttctggttgcaggtgcaaagtgactttgtttattcttgtctcagtctccttgatagccacttcactctgctactactcaactttctcctaaaaatacttcatctattttcagtcctttctttctgtctactcaaaatggttctattaactttgcagtcatgagcttgttccagttacagtccctttgaagttcagggtgataaacagaatattcttctgtagaggaagagaaaggagtgaaagtttagcccactgagacctagagctttgtgatttcctaaccttgaaactctgtaatccctaaagttaaaatctccgcaagtggcacaacttcagaactaatagtatcactttgatttttctttttcctcccttagaaagtttctctagttctatagtttatttgttgaaggtactatgaccaaagaatcagctgctctacaggaatagcatggttccagtgaattagagaaaacctgctgtaaagccatggtagtgtctaagtggtatgttattatgatgtactagcatttatttacagaattatttattaacgtttacttccttcccctctgtaaatgtccatgactattgcccagagaaggcttacccctctctagggttgcagttgctttctttgtaataagtattttgccacacctgtaaaaaaaaaaacctcacttttaactctctgccttgtttgggtaaaggcagtaactaagtttatgtttcagaactgcaaaacaaacaggatagttaccaatatggcccatgtatcagattgatttttgtagcctctcactgaatccaacatatccacaagcaagttatctgtctttctacctgataatctaaattatcaggatatttgttttctgcctaaatgtttatactaagccgaggggagagaggtacctagaccatgtcatctacaagcttcagtaactaaagaaaaaggaacttccctgagtggcttgaatgtgtttgcccacagtctatatctatgtatatagaatgtctgtatgtattttacttatttaatatacattgaatggtaccttgctacagtatttctgacatttagagtagtgttgaaatactcggctagcatcagcaccactatagcactgtccgtgtcatatgagtcactaatattaactccagggacttctggataggctaatagatcattggatacgaagggctcttttgaagcttcagtataccatgtttgcatagtttatctttaaaaacaactttaaaggttcttttgtgagccaggatctcagactgccgtagcatgatgctgtccatctttagcgcatgggctgagaacacctcttccctgaggcttctgaaggttgctgtctgtcatgagtgcatgaaggaggccaagagtttatgctatgggaggaaacagtcactgatttgcctagattctgagagtctggcccatagccaaccacattttcctttgggataatttatttcctgtggcatctagccagaagaaattgaggatgtttcctttcacagctgctccaagcctgttgcccaattcacggtacaagggagcaccccttccctttcctctgaaggtacgccacccacctccgtcgcccacctcagcgcccaggagccttgggacttccttccatatgataaatcattcttcttcacgtcaatacacttcatattaatttctagtacagaaaatcttgacagctatcagaatgccttggtcatagtgttgttgcaaaattgaccatacaggtggcccatgtataaaatctgaattttaggggtttgtccccacctcgcatgctggcttttacagggaggtgtctgggattcctcattagcaatcaaaacttaattactgggatgcagagtccttactttatcgccagcccgtaggcatttctgaagtgcacttttttgaaacatcattttgctaactctcagcagtgtctaattaaactgagcaatacttttgtgaattttaattaatctcagcaaaaccatgatgggagagagtcctctgatggaaatgtagtccctggattatgtgtaacctttttattcctcttagatgcagaggatagaaagcattttttggtgcagtggtcttgtggcaaacacaagaccctctatgcgtctccaactgttatcctaatctagaaaatgaggactggcccctgggcaaaagtgacatgaggaatttactctggaagaggaaaatctgggtggctttccaaggctaagataggtttgtatttcaccctgtggccaagctacagaacttctgagattgtggaagaatttttgcaaccagcagggaaagaggcctcttactgcctaaacacaaagttacactgagcttttctactgtcctttgcctattgctccctctatcatgtaaagatctgggaaggatgagaggcagggcctgcttgtcatgagctgcactcttttctttttaactaatcattgacaattggaagaaaattgacgttaaagaagtttctccattgtcttactaacaaaaccttttgggtttcattaattgtccttgaaattgagttcctttggcatttttccttgcagtcatcagttaagcatgttgcatcctgaattcacagaagtttagctttgcaggtttgaatctctgtaatttaactcccgtggacttggtcgagttttcagcaggttgggagccacctctcttcatttcagcagtgagtcatcccttgacttttcaaatgacagaattttttccaattgtaaaattagcactgtaaaacaaagaaccaaagtggcatcctaagagttgttaaacctgaagtctagtttatgaggaattgtccaagttggagtttaaatagtatctgcttttgtctcaaagcatctaagttattctgacagaaaatggtaagtcagctttgcaggcagatgcgcctctgggcctcctaccttgctccacagctttctggccatcttgtctcccaggccatgccactgctctgccacatgtcagcaaatttctttccaccagtcttatagcatcttacatgatcaaatcatcacagaataaccccgtgatagattattgatagcaatagagaggggctttgtcactgatttttctctcagattccttttccatctctcatccataaaggaaggactgaaatccaaaggcattctccttttgtacctacagtatccagaacccacgtgggcagccttctgcttatgacaataattggcccattgcatgcagagagaatgtcttcatagagagaatgtcattaaatacttgaatctgcatgacagtttgacttgaatgcaacagcaggaaaattttgcaagttacataattgtatatacagtaggttttcttaagtctcttcggttcatcctttgtaatttgtgtgtgtatctgtagtattgcaggcttttggagactattcttacaggcagtatgtcagtcatcaaagaaaatgctgtcacctgccattgttgtatttgtgggtatttatagttgtatgtatgtaaatgcatcagtgtgtagattgcatatcagtgtatggtacatgtacatcaaaattatttttgtccttaatcagtgtgatatgaaaagcaagtacaacctcataggactgattatataatgaagttgttgagagtatatatagtggtattgttttattaaacttaaactcaaataatattttgattaaaatttttaataagactttatgctagaaaattctttgagctttgaatcaccagggcaaaaatgactttcaactaaccttgtgaatcttttgcagtgtactgtgtgcaataccaagggcatagctccctgtaatttgggaaatacagaaagaaaagaaaaaaaaaaaaaaaggcagcctgtgcagtcttagtaactttagtattaagagcacttaaagtcaaactgacaattttgggcttattacaaaatgtgatgctttaaagcacacgttctttattgttgttgtaattagtccataaaaaatatagctttcggaagaattaagtacccaccatatcatttatgtatttgtgtatgttttacgggagatcaaaccactctcgtggtgccgcatccgtactcgcttgacttggaagaaatatcacaagcactaaagtatatcagggcatcccaggattgggtactgtatcctaggtttgcagttgcagaaattagcatctagtgtcacaggtaaaagaatttcaggaccaggtttaaactttattttaaatatttttatacttaggtctctttttcctgcctctccccaaagaagagccactggccttagttgtttgagcttactgcttatattatagagtgtaaataggtaactagagactaaaattttattaaccagcatgtttggtatatttaaagcagtgactgagtgtgtttgagtgagtggctgagtgcagtgtcttttgtttaaacacactgcctcgtgtctttgtagctgattcagagagtttgaattgtggggtgggagactaacttcagctccaggctgcagtaatgtgttggtagttacacttgaggcatttttttgttgttgttaattaactctatagtctcaaactatttttgcaaatatatcatttttcctaattggttcttgacgtgcagtggactggctctgtgaatgattggcagggtcttagttttgcgagagtatttccttctaagaattattgtgatctgcagaaacagccatttgattcaaaaatcatgtagaaaaggagtaggagaagcaaaacgtttcatttttgggccttaaccatttgaaatgtttggactttaaacataaagccatggagtttataaagccaagtaaccatttgatatggataataatatctactctagagagagtatatatatgcacattgatttttaatgctgttaagatacttttgtaaaactgtaggaacaagagtaattagaccaaattgaagcttaggggacagtaaagtggttgctttccatttagggtaaccatgcatgtggttagtcctctcctcctgagattcagaaccagttgactgtccccttaggtgtataaggagaaaagttgacatgtctgggacctctgacatgtgtacacatgcttgcacacatgcacacacagtgaatgttttaagttatacaaacataagaccttaagatgcaaagagccagaatattctaaagaggtgatgaacagagggggtggaaactgcatcacagatgttttccaagggccagggtggaatctgagctctagtgtctgactttgagatgcattatatttttaacacataaatgaggggatccatatcacattctttcttgtggaccaccaaattgaaggctttcttgtaattcacaagcagcagctctccagcatctctccgtagcctgggtgaagtcccagaagctggtgtgcatcattttccaaggtggcagagctgcttgctctgcagatcattcctttgagagaggagtacaagtgaagaaacaaggaggcacttcctgtaggagcactgatgtgccttgtccacactcccctctgagctttactggtaagagagctccgactgaacatgctgagcagttgagcacttttccatcagcaacaacagcgaggatggaaatggaaaggaaccgaactaaaatgcatttccctttgcagggcagagagctaagctcttaggaatagtgttatagaaataagcaccctaacttcaattcctgaaaatgttggttaatggagagaattttggagtttcacttaatattttcccatcggtcgccataaataagtcttcaggcgctcctagaagagtcccagcccaaggctcgattaaggaccacactgcaggtctgaggctcactgctctgagtcctgaacaccagagccctgcagagagtggtgataacacatcatctctgcaaagaggaacctctcccccggccgccacttcactcaggcttctactgagcagcaaggacagcctgggtttcaaatgccacttcccctgctttagggatccaggtgtcctgatagcgtgaccctgctgaggcaaggtatcaactccgagagtgactgagtcactgagcgtggcacatgaacaaacgtcatgacaaagattctctgagtgaagttaacaccacgtattttacctttgcaaaaaacaaactggcaccctgagttctaactacggacggacgatatctttgcctccacacccagattcctggaaatggctaacgtttcctttctaggggaagggtcgaggaatactcaagtgctagcttagcagctttgttcagtccagatcagagctgttaggtaaaggcctaaccacctccctgcagtctcttatatctcaagctttaggaacccatttctaaatgtacactagcggagaatttatattgtcagccttgattaccataggacaggcagaaaggcgataatttgtatcttttaatataaaagaagcttttaacttttccagcctattataataactgagttatattcactgtggctcaaactaattggcattgtggaacatttctttaccttcaaagttttctccaccaatcatttcagttctattgcagtcctggtgccatatgtcccctgcaaattgtgaaagtaattagtgacaaaatagcagcctgctccttttcaatggcgaaactgtcggcattagcagttttgggtaagctggcggtactataacacgtactggaaacctgttcctcatcaccacctaccagattctggaaatgccgtcttctagaaaacgatggcgtttgtggtggtcttcttttgaaaggaacagtaatttgtgtggatattgttaaagtgtttaaagaatattttgacaattaagtttacattttacaattgctttattttttattaaaatagttgtatataaatattaccctatttcactgttgttcaagtaaatctaaaccttgtagacaagtgagtcatctgatatgtatagaagctgtgatatatagagtacatttattgtgtaaatgtttatgaatataattgttcctgtgtttttataagttggggatattttgttgttttacggcaacaaaatttattgcatttaaatggtttttatgtaatagaaatcacgcaaaatagtgaaggatttaaaatatgtatatgatacatgtaaatgtacaaactttagaaagaaataaatccaacaaatttcaatca

SEQ ID NO: 11 - DNA, 11747 bp, Homo sapiens
ctgggattataggcacgaaccaccgcatccagacctctcatctttaactgattgattttcagaggacaattctaggaaagactaaatgttttcaccttttcaaaacaggtgctgttaagagaaggaagatggacggggagcatgccaggatgttggcatttaggacatgggaagttgtataaaggcagagacatttgtttgggtgaacaatgcatctgcacattcccagagtgttgccaaggccaaatatgaatttttatttggcagatctgaagggaaagctccagatactagtgatcatggaggaagcactttactcccaccaaatgtcacaaatgaatttccagaatatgggaccatggaggaaggtggagaaggcctaagggcttctctggaatttgatggtgaggctctgccatgccacccacaagagcagcagggtgtccagcctcttactggctgccactctgggctcgacagtgttacagaaggaccaaaagatgtcagagaggccccctctcaaagtcatctcaaggaacaaagtttacagcccattgactctttgatttcagctctgaaagccacagaagccagaatcatttccggaacattacaggctacaaaggtactggaccaagatgctgtttctagtttttcagttcagcaggtggaaaaagagctggacactgccagtcgtaaaacacagagagtcaacaaaacgctccctgctggccaaaaaaatttaccagaaatacctctttcagctgaagtaacaacggaggaaagtttttatttgagcatccagaaagatctcaccgcgctgttaactggagacactcaggcagagatttcccagataatgaataatgggaggaaaggggctgtctgtgtgcaggagccatcttgtcctttggcctccctcgggagctcagcagtgacctgccactctgcaggcagtgttggtttcttgaaagagcagaggtctgctcttgggagagagcacccagggggatgtgatcgaagcagctccatgggacgcccaggccgggtcaaacatgtggaatttcaaggagtggaaatactgtggacaggaggagacaagagagagacccagcatcctatagattttgagacatcactgcaaagaacagcctctcctgacagcaaagagtcttccaaagtgccacgccatctcatctcatcagctggtttgtgtaattcaagtagtttaactgagaatgtttgggatgaatcctggaaagctccttcagagaggcctggcactagctcggggacattttcccctgtgcgtcttgatgagagtggagaggatgaagtcttcctacaggaaaacaaacagcatcttgagaagacacctaaaccagagagagacagggaaaggatcagcgaacaagaggagcacgttaagggggaagatgaagacatccttgggcctggatatacggaggactccaccgacgtgtacagctcccagtttgaaaccattttggacaacacttctttatactacagtgcagagtccctggagacattatactcagagcctgatagctattttagctttgaaatgcccctcactccaatgatacaacagcgcattaaagaaggtggtcagttcttggagaggacatcagggggaggacatcaggatatcctgagtgtgtctgcagatggtggcatcgtgatgggctattctagtggcgtcaccaatgggctgaatgatgccagcgactccatctacacgaaaggcaccccggagattgctttctggggaagcaatgctggggtgaaaacaacacggctagaagctcattctgaaatggggagcactgaaattttggaaaaggagaccccagaaaatctcagtaatggtaccagcagcaatgtggaagcagccaaaaggttggccaaacgcctttatcagctggacagattcaaaagatcagatgttgcaaaacaccttggcaagaacaacgaatttagcaaactagttgcagaagaatatctgaagttttttgattttacaggaatgacgctggatcagtcactcaggtatttctttaaagcattctctcttgtgggagaaactcaagaacgagagagagttttaatacacttctccaatagatatttttattgtaacccagataccattgcttcacaagatggagtccattgccttacctgtgcaataatgcttcttaataccgatctacatggccacaatattggaaagaagatgacctgtcaggagttcattgcaaatctgcaaggggtaaatgagggtgttgatttctccaaggatctgctgaaagctctgtacaactcaatcaagaatgagaagcttgaatgggcagtagatgatgaagagaaaaaaaagtctccctcagaaagtactgaggagaaagctaacggaacacatccaaagaccatcagtcgtattggaagtactactaacccatttttggacattcctcatgatccaaatgctgctgtgtacaaaagtggattcttggctcggaaaattcatgcagatatggatggaaagaagactccaagaggaaaacgaggatggaaaaccttttatgctgtactgaagggaacagttctttacttgcaaaaggatgaatacaagccagaaaaggccttgtctgaagaggacttgaaaaacgctgtgagtgtgcaccacgcattggcatccaaggccacggactatgagaagaaaccaaacgtgtttaaacttaaaactgccgactggagggtcttgctttttcaaactcagagcccagaggaaatgcaagggtggataaacaaaatcaattgtgtggcagctgtattttctgcaccaccatttccagcagcaatcggctctcagaagaagtttagccgcccacttctgcctgccactacaacaaaactgtctcaggaggagcaactgaagtcacatgaaagtaagctgaagcagatcaccaccgagctggccgagcaccgctcatatccccccgacaagaaggtcaaagccaaggacgtcgatgagtacaaactgaaagaccactatctggagtttgagaaaacccgctatgaaatgtatgtcagcattctcaaggaaggaggcaaagagctactgagtaacgatgaaagcgaggctgcaggactgaagaagtcgcactcgagtccttcgctgaacccggatacttctccaatcactgccaaagtcaagcgtaacgtgtcagagaggaaggatcaccgacctgaaacaccaagcattaagcaaaaagttacttagagtccatctgcggccaggaagtgctggtcatggagcaaaatagggtttttcaagatctttctggtaatccgtgaatatatttaaaaaaaaaaagtctgtgacaaaacggtgcattagtaattttttctattgtatatttttgttagtttctgtacagattgtctttgctcttgatttcttttgctttgatgatttttgcaacttgatagctaatgcaccttttctgtgaggaggaggggatcgtgatttcagaatgaattatgtatcccttctcttttggttttctcttgtttgcagtctgctcagttgttttatgtattctcatatcaactgttaaacttttttttaaggttaaagaatttaatccattgtgaaacacttaactggacaaactgtagttttagtaaattctagctggagttaatatacgcctttatatgtgaaatcttgcccagtcacagaggtagaattgagcactcacagatgctccagtaagaatcacagtgctgggaatctagttgctccaatatgaggcagcttcatgtgcagcttagcacttgttgttgagatcggaccctgctggaagcagggaaaagaagcgtgaagatcgtaggattgagaacttagggaagcacattagcttgcttgaagtgctgattccatttcagccaagcaagggaaagaggaagtggagtcattttgcctttgaaggctgaggaaagattgatacccagttaattttgtttgctaaaggatgggggcaataatcggcccttgaggagctgcagcagtaggcatgtgctcagtctgcaggaattgttacctcactcccacagggtctagactagaaatccatcatctctatcgttgatatccttccatccaggaatagatttttcttactctacatatgtgtgtgtgcgtgcgtgtgtgtgcgtgtgtgggcatggggttgtgtcctggttgtgatattgaggtcttccttcctaacaaattaatactaaaatgaaacagcttttcttgtgtccttaagacaaaataaggaaggaaaacgtagctgcagttgtccacgatggatattggttctttaaaatatatctgaaagtagtagtcagaatgaattatggttggaaaactgaggaatcttctggttgcaggtgcaaagtgactttgtttattcttgtctcagtctccttgatagccacttcactctgctactactcaactttctcctaaaaatacttcatctattttcagtcctttctttctgtctactcaaaatggttctattaactttgcagtcatgagcttgttccagttacagtccctttgaagttcagggtgataaacagaatattcttctgtagaggaagagaaaggagtgaaagtttagcccactgagacctagagctttgtgatttcctaaccttgaaactctgtaatccctaaagttaaaatctccgcaagtggcacaacttcagaactaatagtatcactttgatttttctttttcctcccttagaaagtttctctagttctatagtttatttgttgaaggtactatgaccaaagaatcagctgctctacaggaatagcatggttccagtgaattagagaaaacctgctgtaaagccatggtagtgtctaagtggtatgttattatgatgtactagcatttatttacagaattatttattaacgtttacttccttcccctctgtaaatgtccatgactattgcccagagaaggcttacccctctctagggttgcagttgctttctttgtaataagtattttgccacacctgtaaaaaaaaaaacctcacttttaactctctgccttgtttgggtaaaggcagtaactaagtttatgtttcagaactgcaaaacaaacaggatagttaccaatatggcccatgtatcagattgatttttgtagcctctcactgaatccaacatatccacaagcaagttatctgtctttctacctgataatctaaattatcaggatatttgttttctgcctaaatgtttatactaagccgaggggagagaggtacctagaccatgtcatctacaagcttcagtaactaaagaaaaaggaacttccctgagtggcttgaatgtgtttgcccacagtctatatctatgtatatagaatgtctgtatgtattttacttatttaatatacattgaatggtaccttgctacagtatttctgacatttagagtagtgttgaaatactcggctagcatcagcaccactatagcactgtccgtgtcatatgagtcactaatattaactccagggacttctggataggctaatagatcattggatacgaagggctcttttgaagcttcagtataccatgtttgcatagtttatctttaaaaacaactttaaaggttcttttgtgagccaggatctcagactgccgtagcatgatgctgtccatctttagcgcatgggctgagaacacctcttccctgaggcttctgaaggttgctgtctgtcatgagtgcatgaaggaggccaagagtttatgctatgggaggaaacagtcactgatttgcctagattctgagagtctggcccatagccaaccacattttcctttgggataatttatttcctgtggcatctagccagaagaaattgaggatgtttcctttcacagctgctccaagcctgttgcccaattcacggtacaagggagcaccccttccctttcctctgaaggtacgccacccacctccgtcgcccacctcagcgcccaggagccttgggacttccttccatatgataaatcattcttcttcacgtcaatacacttcatattaatttctagtacagaaaatcttgacagctatcagaatgccttggtcatagtgttgttgcaaaattgaccatacaggtggcccatgtataaaatctgaattttaggggtttgtccccacctcgcatgctggcttttacagggaggtgtctgggattcctcattagcaatcaaaacttaattactgggatgcagagtccttactttatcgccagcccgtaggcatttctgaagtgcacttttttgaaacatcattttgctaactctcagcagtgtctaattaaactgagcaatacttttgtgaattttaattaatctcagcaaaaccatgatgggagagagtcctctgatggaaatgtagtccctggattatgtgtaacctttttattcctcttagatgcagaggatagaaagcattttttggtgcagtggtcttgtggcaaacacaagaccctctatgcgtctccaactgttatcctaatctagaaaatgaggactggcccctgggcaaaagtgacatgaggaatttactctggaagaggaaaatctgggtggctttccaaggctaagataggtttgtatttcaccctgtggccaagctacagaacttctgagattgtggaagaatttttgcaaccagcagggaaagaggcctcttactgcctaaacacaaagttacactgagcttttctactgtcctttgcctattgctccctctatcatgtaaagatctgggaaggatgagaggcagggcctgcttgtcatgagctgcactcttttctttttaactaatcattgacaattggaagaaaattgacgttaaagaagtttctccattgtcttactaacaaaaccttttgggtttcattaattgtccttgaaattgagttcctttggcatttttccttgcagtcatcagttaagcatgttgcatcctgaattcacagaagtttagctttgcaggtttgaatctctgtaatttaactcccgtggacttggtcgagttttcagcaggttgggagccacctctcttcatttcagcagtgagtcatcccttgacttttcaaatgacagaattttttccaattgtaaaattagcactgtaaaacaaagaaccaaagtggcatcctaagagttgttaaacctgaagtctagtttatgaggaattgtccaagttggagtttaaatagtatctgcttttgtctcaaagcatctaagttattctgacagaaaatggtaagtcagctttgcaggcagatgcgcctctgggcctcctaccttgctccacagctttctggccatcttgtctcccaggccatgccactgctctgccacatgtcagcaaatttctttccaccagtcttatagcatcttacatgatcaaatcatcacagaataaccccgtgatagattattgatagcaatagagaggggctttgtcactgatttttctctcagattccttttccatctctcatccataaaggaaggactgaaatccaaaggcattctccttttgtacctacagtatccagaacccacgtgggcagccttctgcttatgacaataattggcccattgcatgcagagagaatgtcttcatagagagaatgtcattaaatacttgaatctgcatgacagtttgacttgaatgcaacagcaggaaaattttgcaagttacataattgtatatacagtaggttttcttaagtctcttcggttcatcctttgtaatttgtgtgtgtatctgtagtattgcaggcttttggagactattcttacaggcagtatgtcagtcatcaaagaaaatgctgtcacctgccattgttgtatttgtgggtatttatagttgtatgtatgtaaatgcatcagtgtgtagattgcatatcagtgtatggtacatgtacatcaaaattatttttgtccttaatcagtgtgatatgaaaagcaagtacaacctcataggactgattatataatgaagttgttgagagtatatatagtggtattgttttattaaacttaaactcaaataatattttgattaaaatttttaataagactttatgctagaaaattctttgagctttgaatcaccagggcaaaaatgactttcaactaaccttgtgaatcttttgcagtgtactgtgtgcaataccaagggcatagctccctgtaatttgggaaatacagaaagaaaagaaaaaaaaaaaaaaaggcagcctgtgcagtcttagtaactttagtattaagagcacttaaagtcaaactgacaattttgggcttattacaaaatgtgatgctttaaagcacacgttctttattgttgttgtaattagtccataaaaaatatagctttcggaagaattaagtacccaccatatcatttatgtatttgtgtatgttttacgggagatcaaaccactctcgtggtgccgcatccgtactcgcttgacttggaagaaatatcacaagcactaaagtatatcagggcatcccaggattgggtactgtatcctaggtttgcagttgcagaaattagcatctagtgtcacaggtaaaagaatttcaggaccaggtttaaactttattttaaatatttttatacttaggtctctttttcctgcctctccccaaagaagagccactggccttagttgtttgagcttactgcttatattatagagtgtaaataggtaactagagactaaaattttattaaccagcatgtttggtatatttaaagcagtgactgagtgtgtttgagtgagtggctgagtgcagtgtcttttgtttaaacacactgcctcgtgtctttgtagctgattcagagagtttgaattgtggggtgggagactaacttcagctccaggctgcagtaatgtgttggtagttacacttgaggcatttttttgttgttgttaattaactctatagtctcaaactatttttgcaaatatatcatttttcctaattggttcttgacgtgcagtggactggctctgtgaatgattggcagggtcttagttttgcgagagtatttccttctaagaattattgtgatctgcagaaacagccatttgattcaaaaatcatgtagaaaaggagtaggagaagcaaaacgtttcatttttgggccttaaccatttgaaatgtttggactttaaacataaagccatggagtttataaagccaagtaaccatttgatatggataataatatctactctagagagagtatatatatgcacattgatttttaatgctgttaagatacttttgtaaaactgtaggaacaagagtaattagaccaaattgaagcttaggggacagtaaagtggttgctttccatttagggtaaccatgcatgtggttagtcctctcctcctgagattcagaaccagttgactgtccccttaggtgtataaggagaaaagttgacatgtctgggacctctgacatgtgtacacatgcttgcacacatgcacacacagtgaatgttttaagttatacaaacataagaccttaagatgcaaagagccagaatattctaaagaggtgatgaacagagggggtggaaactgcatcacagatgttttccaagggccagggtggaatctgagctctagtgtctgactttgagatgcattatatttttaacacataaatgaggggatccatatcacattctttcttgtggaccaccaaattgaaggctttcttgtaattcacaagcagcagctctccagcatctctccgtagcctgggtgaagtcccagaagctggtgtgcatcattttccaaggtggcagagctgcttgctctgcagatcattcctttgagagaggagtacaagtgaagaaacaaggaggcacttcctgtaggagcactgatgtgccttgtccacactcccctctgagctttactggtaagagagctccgactgaacatgctgagcagttgagcacttttccatcagcaacaacagcgaggatggaaatggaaaggaaccgaactaaaatgcatttccctttgcagggcagagagctaagctcttaggaatagtgttatagaaataagcaccctaacttcaattcctgaaaatgttggttaatggagagaattttggagtttcacttaatattttcccatcggtcgccataaataagtcttcaggcgctcctagaagagtcccagcccaaggctcgattaaggaccacactgcaggtctgaggctcactgctctgagtcctgaacaccagagccctgcagagagtggtgataacacatcatctctgcaaagaggaacctctcccccggccgccacttcactcaggcttctactgagcagcaaggacagcctgggtttcaaatgccacttcccctgctttagggatccaggtgtcctgatagcgtgaccctgctgaggcaaggtatcaactccgagagtgactgagtcactgagcgtggcacatgaacaaacgtcatgacaaagattctctgagtgaagttaacaccacgtattttacctttgcaaaaaacaaactggcaccctgagttctaactacggacggacgatatctttgcctccacacccagattcctggaaatggctaacgtttcctttctaggggaagggtcgaggaatactcaagtgctagcttagcagctttgttcagtccagatcagagctgttaggtaaaggcctaaccacctccctgcagtctcttatatctcaagctttaggaacccatttctaaatgtacactagcggagaatttatattgtcagccttgattaccataggacaggcagaaaggcgataatttgtatcttttaatataaaagaagcttttaacttttccagcctattataataactgagttatattcactgtggctcaaactaattggcattgtggaacatttctttaccttcaaagttttctccaccaatcatttcagttctattgcagtcctggtgccatatgtcccctgcaaattgtgaaagtaattagtgacaaaatagcagcctgctccttttcaatggcgaaactgtcggcattagcagttttgggtaagctggcggtactataacacgtactggaaacctgttcctcatcaccacctaccagattctggaaatgccgtcttctagaaaacgatggcgtttgtggtggtcttcttttgaaaggaacagtaatttgtgtggatattgttaaagtgtttaaagaatattttgacaattaagtttacattttacaattgctttattttttattaaaatagttgtatataaatattaccctatttcactgttgttcaagtaaatctaaaccttgtagacaagtgagtcatctgatatgtatagaagctgtgatatatagagtacatttattgtgtaaatgtttatgaatataattgttcctgtgtttttataagttggggatattttgttgttttacggcaacaaaatttattgcatttaaatggtttttatgtaatagaaatcacgcaaaatagtgaaggatttaaaatatgtatatgatacatgtaaatgtacaaactttagaaagaaataaatccaacaaatttcaatca

SEQ ID NO: 12 - DNA, 11961 bp, Homo sapiens
agatgacagccccacctctgatgtcacccaggatggtacaatcctctccaagcctttgctgggcttcctgctgctgcactgggggacatggttacattaaagctaactcccgtcatctcaattatctccttggaagtagttttcacaaatataaaaacgccctacggtggctgttttcggtaagctaccaaggtagagagcggcagaggcagacagggagagcaaacgggagaacaggctgcttccgcctttgtgagagggactgaggcagcagctcctctcggctcgggttccaagtgctcaaagtgcttccatttccatcaccgtgtgcagtgcagggcaaaaggggctgccaggaaatctgaaactaatttgcttccagttgactagaacagcatattttgaattagcttgcttctttttaagctaacttttctcaagcgttaaactgatgaactgggcattttctatgatcaatgggtaactgctggagctacagtaatctctgtgatcatggaggaagcactttactcccaccaaatgtcacaaatgaatttccagaatatgggaccatggaggaaggtggagaaggcctaagggcttctctggaatttgatggtgaggctctgccatgccacccacaagagcagcagggtgtccagcctcttactggctgccactctgggctcgacagtgttacagaaggaccaaaagatgtcagagaggccccctctcaaagtcatctcaaggaacaaagtttacagcccattgactctttgatttcagctctgaaagccacagaagccagaatcatttccggaacattacaggctacaaaggtactggaccaagatgctgtttctagtttttcagttcagcaggtggaaaaagagctggacactgccagtcgtaaaacacagagagtcaacaaaacgctccctgctggccaaaaaaatttaccagaaatacctctttcagctgaagtaacaacggaggaaagtttttatttgagcatccagaaagatctcaccgcgctgttaactggagacactcaggcagagatttcccagataatgaataatgggaggaaaggggctgtctgtgtgcaggagccatcttgtcctttggcctccctcgggagctcagcagtgacctgccactctgcaggcagtgttggtttcttgaaagagcagaggtctgctcttgggagagagcacccagggggatgtgatcgaagcagctccatgggacgcccaggccgggtcaaacatgtggaatttcaaggagtggaaatactgtggacaggaggagacaagagagagacccagcatcctatagattttgagacatcactgcaaagaacagcctctcctgacagcaaagagtcttccaaagtgccacgccatctcatctcatcagctggtttgtgtaattcaagtagtttaactgagaatgtttgggatgaatcctggaaagctccttcagagaggcctggcactagctcggggacattttcccctgtgcgtcttgatgagagtggagaggatgaagtcttcctacaggaaaacaaacagcatcttgagaagacacctaaaccagagagagacagggaaaggatcagcgaacaagaggagcacgttaagggggaagatgaagacatccttgggcctggatatacggaggactccaccgacgtgtacagctcccagtttgaaaccattttggacaacacttctttatactacagtgcagagtccctggagacattatactcagagcctgatagctattttagctttgaaatgcccctcactccaatgatacaacagcgcattaaagaaggtggtcagttcttggagaggacatcagggggaggacatcaggatatcctgagtgtgtctgcagatggtggcatcgtgatgggctattctagtggcgtcaccaatgggctgaatgatgccagcgactccatctacacgaaaggcaccccggagattgctttctggggaagcaatgctggggtgaaaacaacacggctagaagctcattctgaaatggggagcactgaaattttggaaaaggagaccccagaaaatctcagtaatggtaccagcagcaatgtggaagcagccaaaaggttggccaaacgcctttatcagctggacagattcaaaagatcagatgttgcaaaacaccttggcaagaacaacgaatttagcaaactagttgcagaagaatatctgaagttttttgattttacaggaatgacgctggatcagtcactcaggtatttctttaaagcattctctcttgtgggagaaactcaagaacgagagagagttttaatacacttctccaatagatatttttattgtaacccagataccattgcttcacaagatggagtccattgccttacctgtgcaataatgcttcttaataccgatctacatggccacaatattggaaagaagatgacctgtcaggagttcattgcaaatctgcaaggggtaaatgagggtgttgatttctccaaggatctgctgaaagctctgtacaactcaatcaagaatgagaagcttgaatgggcagtagatgatgaagagaaaaaaaagtctccctcagaaagtactgaggagaaagctaacggaacacatccaaagaccatcagtcgtattggaagtactactaacccatttttggacattcctcatgatccaaatgctgctgtgtacaaaagtggattcttggctcggaaaattcatgcagatatggatggaaagaagactccaagaggaaaacgaggatggaaaaccttttatgctgtactgaagggaacagttctttacttgcaaaaggatgaatacaagccagaaaaggccttgtctgaagaggacttgaaaaacgctgtgagtgtgcaccacgcattggcatccaaggccacggactatgagaagaaaccaaacgtgtttaaacttaaaactgccgactggagggtcttgctttttcaaactcagagcccagaggaaatgcaagggtggataaacaaaatcaattgtgtggcagctgtattttctgcaccaccatttccagcagcaatcggctctcagaagaagtttagccgcccacttctgcctgccactacaacaaaactgtctcaggaggagcaactgaagtcacatgaaagtaagctgaagcagatcaccaccgagctggccgagcaccgctcatatccccccgacaagaaggtcaaagccaaggacgtcgatgagtacaaactgaaagaccactatctggagtttgagaaaacccgctatgaaatgtatgtcagcattctcaaggaaggaggcaaagagctactgagtaacgatgaaagcgaggctgcaggactgaagaagtcgcactcgagtccttcgctgaacccggatacttctccaatcactgccaaagtcaagcgtaacgtgtcagagaggaaggatcaccgacctgaaacaccaagcattaagcaaaaagttacttagagtccatctgcggccaggaagtgctggtcatggagcaaaatagggtttttcaagatctttctggtaatccgtgaatatatttaaaaaaaaaaagtctgtgacaaaacggtgcattagtaattttttctattgtatatttttgttagtttctgtacagattgtctttgctcttgatttcttttgctttgatgatttttgcaacttgatagctaatgcaccttttctgtgaggaggaggggatcgtgatttcagaatgaattatgtatcccttctcttttggttttctcttgtttgcagtctgctcagttgttttatgtattctcatatcaactgttaaacttttttttaaggttaaagaatttaatccattgtgaaacacttaactggacaaactgtagttttagtaaattctagctggagttaatatacgcctttatatgtgaaatcttgcccagtcacagaggtagaattgagcactcacagatgctccagtaagaatcacagtgctgggaatctagttgctccaatatgaggcagcttcatgtgcagcttagcacttgttgttgagatcggaccctgctggaagcagggaaaagaagcgtgaagatcgtaggattgagaacttagggaagcacattagcttgcttgaagtgctgattccatttcagccaagcaagggaaagaggaagtggagtcattttgcctttgaaggctgaggaaagattgatacccagttaattttgtttgctaaaggatgggggcaataatcggcccttgaggagctgcagcagtaggcatgtgctcagtctgcaggaattgttacctcactcccacagggtctagactagaaatccatcatctctatcgttgatatccttccatccaggaatagatttttcttactctacatatgtgtgtgtgcgtgcgtgtgtgtgcgtgtgtgggcatggggttgtgtcctggttgtgatattgaggtcttccttcctaacaaattaatactaaaatgaaacagcttttcttgtgtccttaagacaaaataaggaaggaaaacgtagctgcagttgtccacgatggatattggttctttaaaatatatctgaaagtagtagtcagaatgaattatggttggaaaactgaggaatcttctggttgcaggtgcaaagtgactttgtttattcttgtctcagtctccttgatagccacttcactctgctactactcaactttctcctaaaaatacttcatctattttcagtcctttctttctgtctactcaaaatggttctattaactttgcagtcatgagcttgttccagttacagtccctttgaagttcagggtgataaacagaatattcttctgtagaggaagagaaaggagtgaaagtttagcccactgagacctagagctttgtgatttcctaaccttgaaactctgtaatccctaaagttaaaatctccgcaagtggcacaacttcagaactaatagtatcactttgatttttctttttcctcccttagaaagtttctctagttctatagtttatttgttgaaggtactatgaccaaagaatcagctgctctacaggaatagcatggttccagtgaattagagaaaacctgctgtaaagccatggtagtgtctaagtggtatgttattatgatgtactagcatttatttacagaattatttattaacgtttacttccttcccctctgtaaatgtccatgactattgcccagagaaggcttacccctctctagggttgcagttgctttctttgtaataagtattttgccacacctgtaaaaaaaaaaacctcacttttaactctctgccttgtttgggtaaaggcagtaactaagtttatgtttcagaactgcaaaacaaacaggatagttaccaatatggcccatgtatcagattgatttttgtagcctctcactgaatccaacatatccacaagcaagttatctgtctttctacctgataatctaaattatcaggatatttgttttctgcctaaatgtttatactaagccgaggggagagaggtacctagaccatgtcatctacaagcttcagtaactaaagaaaaaggaacttccctgagtggcttgaatgtgtttgcccacagtctatatctatgtatatagaatgtctgtatgtattttacttatttaatatacattgaatggtaccttgctacagtatttctgacatttagagtagtgttgaaatactcggctagcatcagcaccactatagcactgtccgtgtcatatgagtcactaatattaactccagggacttctggataggctaatagatcattggatacgaagggctcttttgaagcttcagtataccatgtttgcatagtttatctttaaaaacaactttaaaggttcttttgtgagccaggatctcagactgccgtagcatgatgctgtccatctttagcgcatgggctgagaacacctcttccctgaggcttctgaaggttgctgtctgtcatgagtgcatgaaggaggccaagagtttatgctatgggaggaaacagtcactgatttgcctagattctgagagtctggcccatagccaaccacattttcctttgggataatttatttcctgtggcatctagccagaagaaattgaggatgtttcctttcacagctgctccaagcctgttgcccaattcacggtacaagggagcaccccttccctttcctctgaaggtacgccacccacctccgtcgcccacctcagcgcccaggagccttgggacttccttccatatgataaatcattcttcttcacgtcaatacacttcatattaatttctagtacagaaaatcttgacagctatcagaatgccttggtcatagtgttgttgcaaaattgaccatacaggtggcccatgtataaaatctgaattttaggggtttgtccccacctcgcatgctggcttttacagggaggtgtctgggattcctcattagcaatcaaaacttaattactgggatgcagagtccttactttatcgccagcccgtaggcatttctgaagtgcacttttttgaaacatcattttgctaactctcagcagtgtctaattaaactgagcaatacttttgtgaattttaattaatctcagcaaaaccatgatgggagagagtcctctgatggaaatgtagtccctggattatgtgtaacctttttattcctcttagatgcagaggatagaaagcattttttggtgcagtggtcttgtggcaaacacaagaccctctatgcgtctccaactgttatcctaatctagaaaatgaggactggcccctgggcaaaagtgacatgaggaatttactctggaagaggaaaatctgggtggctttccaaggctaagataggtttgtatttcaccctgtggccaagctacagaacttctgagattgtggaagaatttttgcaaccagcagggaaagaggcctcttactgcctaaacacaaagttacactgagcttttctactgtcctttgcctattgctccctctatcatgtaaagatctgggaaggatgagaggcagggcctgcttgtcatgagctgcactcttttctttttaactaatcattgacaattggaagaaaattgacgttaaagaagtttctccattgtcttactaacaaaaccttttgggtttcattaattgtccttgaaattgagttcctttggcatttttccttgcagtcatcagttaagcatgttgcatcctgaattcacagaagtttagctttgcaggtttgaatctctgtaatttaactcccgtggacttggtcgagttttcagcaggttgggagccacctctcttcatttcagcagtgagtcatcccttgacttttcaaatgacagaattttttccaattgtaaaattagcactgtaaaacaaagaaccaaagtggcatcctaagagttgttaaacctgaagtctagtttatgaggaattgtccaagttggagtttaaatagtatctgcttttgtctcaaagcatctaagttattctgacagaaaatggtaagtcagctttgcaggcagatgcgcctctgggcctcctaccttgctccacagctttctggccatcttgtctcccaggccatgccactgctctgccacatgtcagcaaatttctttccaccagtcttatagcatcttacatgatcaaatcatcacagaataaccccgtgatagattattgatagcaatagagaggggctttgtcactgatttttctctcagattccttttccatctctcatccataaaggaaggactgaaatccaaaggcattctccttttgtacctacagtatccagaacccacgtgggcagccttctgcttatgacaataattggcccattgcatgcagagagaatgtcttcatagagagaatgtcattaaatacttgaatctgcatgacagtttgacttgaatgcaacagcaggaaaattttgcaagttacataattgtatatacagtaggttttcttaagtctcttcggttcatcctttgtaatttgtgtgtgtatctgtagtattgcaggcttttggagactattcttacaggcagtatgtcagtcatcaaagaaaatgctgtcacctgccattgttgtatttgtgggtatttatagttgtatgtatgtaaatgcatcagtgtgtagattgcatatcagtgtatggtacatgtacatcaaaattatttttgtccttaatcagtgtgatatgaaaagcaagtacaacctcataggactgattatataatgaagttgttgagagtatatatagtggtattgttttattaaacttaaactcaaataatattttgattaaaatttttaataagactttatgctagaaaattctttgagctttgaatcaccagggcaaaaatgactttcaactaaccttgtgaatcttttgcagtgtactgtgtgcaataccaagggcatagctccctgtaatttgggaaatacagaaagaaaagaaaaaaaaaaaaaaaggcagcctgtgcagtcttagtaactttagtattaagagcacttaaagtcaaactgacaattttgggcttattacaaaatgtgatgctttaaagcacacgttctttattgttgttgtaattagtccataaaaaatatagctttcggaagaattaagtacccaccatatcatttatgtatttgtgtatgttttacgggagatcaaaccactctcgtggtgccgcatccgtactcgcttgacttggaagaaatatcacaagcactaaagtatatcagggcatcccaggattgggtactgtatcctaggtttgcagttgcagaaattagcatctagtgtcacaggtaaaagaatttcaggaccaggtttaaactttattttaaatatttttatacttaggtctctttttcctgcctctccccaaagaagagccactggccttagttgtttgagcttactgcttatattatagagtgtaaataggtaactagagactaaaattttattaaccagcatgtttggtatatttaaagcagtgactgagtgtgtttgagtgagtggctgagtgcagtgtcttttgtttaaacacactgcctcgtgtctttgtagctgattcagagagtttgaattgtggggtgggagactaacttcagctccaggctgcagtaatgtgttggtagttacacttgaggcatttttttgttgttgttaattaactctatagtctcaaactatttttgcaaatatatcatttttcctaattggttcttgacgtgcagtggactggctctgtgaatgattggcagggtcttagttttgcgagagtatttccttctaagaattattgtgatctgcagaaacagccatttgattcaaaaatcatgtagaaaaggagtaggagaagcaaaacgtttcatttttgggccttaaccatttgaaatgtttggactttaaacataaagccatggagtttataaagccaagtaaccatttgatatggataataatatctactctagagagagtatatatatgcacattgatttttaatgctgttaagatacttttgtaaaactgtaggaacaagagtaattagaccaaattgaagcttaggggacagtaaagtggttgctttccatttagggtaaccatgcatgtggttagtcctctcctcctgagattcagaaccagttgactgtccccttaggtgtataaggagaaaagttgacatgtctgggacctctgacatgtgtacacatgcttgcacacatgcacacacagtgaatgttttaagttatacaaacataagaccttaagatgcaaagagccagaatattctaaagaggtgatgaacagagggggtggaaactgcatcacagatgttttccaagggccagggtggaatctgagctctagtgtctgactttgagatgcattatatttttaacacataaatgaggggatccatatcacattctttcttgtggaccaccaaattgaaggctttcttgtaattcacaagcagcagctctccagcatctctccgtagcctgggtgaagtcccagaagctggtgtgcatcattttccaaggtggcagagctgcttgctctgcagatcattcctttgagagaggagtacaagtgaagaaacaaggaggcacttcctgtaggagcactgatgtgccttgtccacactcccctctgagctttactggtaagagagctccgactgaacatgctgagcagttgagcacttttccatcagcaacaacagcgaggatggaaatggaaaggaaccgaactaaaatgcatttccctttgcagggcagagagctaagctcttaggaatagtgttatagaaataagcaccctaacttcaattcctgaaaatgttggttaatggagagaattttggagtttcacttaatattttcccatcggtcgccataaataagtcttcaggcgctcctagaagagtcccagcccaaggctcgattaaggaccacactgcaggtctgaggctcactgctctgagtcctgaacaccagagccctgcagagagtggtgataacacatcatctctgcaaagaggaacctctcccccggccgccacttcactcaggcttctactgagcagcaaggacagcctgggtttcaaatgccacttcccctgctttagggatccaggtgtcctgatagcgtgaccctgctgaggcaaggtatcaactccgagagtgactgagtcactgagcgtggcacatgaacaaacgtcatgacaaagattctctgagtgaagttaacaccacgtattttacctttgcaaaaaacaaactggcaccctgagttctaactacggacggacgatatctttgcctccacacccagattcctggaaatggctaacgtttcctttctaggggaagggtcgaggaatactcaagtgctagcttagcagctttgttcagtccagatcagagctgttaggtaaaggcctaaccacctccctgcagtctcttatatctcaagctttaggaacccatttctaaatgtacactagcggagaatttatattgtcagccttgattaccataggacaggcagaaaggcgataatttgtatcttttaatataaaagaagcttttaacttttccagcctattataataactgagttatattcactgtggctcaaactaattggcattgtggaacatttctttaccttcaaagttttctccaccaatcatttcagttctattgcagtcctggtgccatatgtcccctgcaaattgtgaaagtaattagtgacaaaatagcagcctgctccttttcaatggcgaaactgtcggcattagcagttttgggtaagctggcggtactataacacgtactggaaacctgttcctcatcaccacctaccagattctggaaatgccgtcttctagaaaacgatggcgtttgtggtggtcttcttttgaaaggaacagtaatttgtgtggatattgttaaagtgtttaaagaatattttgacaattaagtttacattttacaattgctttattttttattaaaatagttgtatataaatattaccctatttcactgttgttcaagtaaatctaaaccttgtagacaagtgagtcatctgatatgtatagaagctgtgatatatagagtacatttattgtgtaaatgtttatgaatataattgttcctgtgtttttataagttggggatattttgttgttttacggcaacaaaatttattgcatttaaatggtttttatgtaatagaaatcacgcaaaatagtgaaggatttaaaatatgtatatgatacatgtaaatgtacaaactttagaaagaaataaatccaacaaatttcaatca

SEQ ID NO: 13 - DNA, 4084 bp, Homo sapiens
ctcaaaaagattcctttccccctaagaggtactgagcctatagaaatactctgaatgtgagtgagtcaactgaattttaaggctgtcggtggaaccatggggctgagtcacgtctgcccacagctgctgctgttcgcatccctgggcactgaggcctgaaactccaccctggcagggaccagcccgacccccctggaggaaatggccgggcagtttcagcagcagcagatgaaaacttccttcctcttcatccagctgcgggctcctccagcctgcactctccccgccccgtctccagcggcaaccccagggggcctggaggagggacacagtttcccaagtcccaggacaggcctcttggcaggctgggacctcaggcgcacacagggctcagctgcccctcctttgaggctgctgcagaaggcaggccctgagacggaggaatcagctgctttcacttgctctgctccaaaggaaaagaaggaagggaggaaaaaatcccaggatccggacgtaagcaggggtggtgattgcagatccccacatcacaggcattgccaggcccctgcctccaagacactgggctggctacagcccctggcatggaggcttcctagcccagctcccatcatgagtgatgaaagcagcagtccctccatgggctggaagcactggccagtcacttctgccacccaggatctgtggggcatggacccccgatgcagggatgccttgggatgctcccctccaagggctgtcctggtccacgctgcagatggagcggaaaggactgtgctgaggagaggcgccgagacctgccaaatactccccaggagctgtaaggaggccacaggtaccacagcgcaggcgacaagggcatggctctacaggtactgtccagctgtgcacaccagcaagggctgcccagccccgcctgccactctgcctctcaaggcagagacatttgtttgggtgaacaatgcatctgcacattcccagagtgttgccaaggccaaatatgaatttttatttggcagatctgaagggaaagctccagatactagtgatcatggaggaagcactttactcccaccaaatgtcacaaatgaatttccagaatatgggaccatggaggaaggtggagaaggcctaagggcttctctggaatttgatggtgaggctctgccatgccacccacaagagcagcagggtgtccagcctcttactggctgccactctgggctcgacagtgttacagaaggaccaaaagatgtcagagaggccccctctcaaagtcatctcaaggaacaaagtttacagcccattgactctttgatttcagctctgaaagccacagaagccagaatcatttccggaacattacaggctacaaaggtactggaccaagatgctgtttctagtttttcagttcagcaggtggaaaaagagctggacactgccagtcgtaaaacacagagagtcaacaaaacgctccctgctggccaaaaaaatttaccagaaatacctctttcagctgaagtaacaacggaggaaagtttttatttgagcatccagaaagatctcaccgcgctgttaactggagacactcaggcagagatttcccagataatgaataatgggaggaaaggggctgtctgtgtgcaggagccatcttgtcctttggcctccctcgggagctcagcagtgacctgccactctgcaggcagtgttggtttcttgaaagagcagaggtctgctcttgggagagagcacccagggggatgtgatcgaagcagctccatgggacgcccaggccgggtcaaacatgtggaatttcaaggagtggaaatactgtggacaggaggagacaagagagagacccagcatcctatagattttgagacatcactgcaaagaacagcctctcctgacagcaaagagtcttccaaagtgccacgccatctcatctcatcagctggtttgtgtaattcaagtagtttaactgagaatgtttgggatgaatcctggaaagctccttcagagaggcctggcactagctcggggacattttcccctgtgcgtcttgatgagagtggagaggatgaagtcttcctacaggaaaacaaacagcatcttgagaagacacctaaaccagagagagacagggaaaggatcagcgaacaagaggagcacgttaagggggaagatgaagacatccttgggcctggatatacggaggactccaccgacgtgtacagctcccagtttgaaaccattttggacaacacttctttatactacagtgcagagtccctggagacattatactcagagcctgatagctattttagctttgaaatgcccctcactccaatgatacaacagcgcattaaagaaggtggtcagttcttggagaggacatcagggggaggacatcaggatatcctgagtgtgtctgcagatggtggcatcgtgatgggctattctagtggcgtcaccaatgggctgaatgatgccagcgactccatctacacgaaaggcaccccggagattgctttctggggaagcaatgctggggtgaaaacaacacggctagaagctcattctgaaatggggagcactgaaattttggaaaaggagaccccagaaaatctcagtaatggtaccagcagcaatgtggaagcagccaaaaggttggccaaacgcctttatcagctggacagattcaaaagatcagatgttgcaaaacaccttggcaagaacaacgaatttagcaaactagttgcagaagaatatctgaagttttttgattttacaggaatgacgctggatcagtcactcaggtatttctttaaagcattctctcttgtgggagaaactcaagaacgagagagagttttaatacacttctccaatagatatttttattgtaacccagataccattgcttcacaagatggagtccattgccttacctgtgcaataatgcttcttaataccgatctacatggccacaatattggaaagaagatgacctgtcaggagttcattgcaaatctgcaaggggtaaatgagggtgttgatttctccaaggatctgctgaaacattttcaaaagattattcccaaaggactacacaagaggaagaagcagacctcagtcagaaaaaggtctgaactttttataaaggaaaagcctgaactgaattctcaaaaatacttgatctgagttatattcggagtatgtagttgaaaataggaacttatgggtggtatttaagtgtagctaaaaaaagagcatcaactgttgcctagagtaggtgagttctttccaagagaaggtcatggaaacctggtagcaacagtatccatggaggaagagggcttggatgcctgtcctgtgtaagtcggagagccttttaagagaaaagctaggtttgcaagctttttaagagaaaagctttaaaggttctggcttaaaatatggaatattgctgcttttttcagtaaagtaaatcaagctgagttaggtgatgaaaggtgcgtggcgtgtttccgcttctgccctccccgtggaggtctggcagcctgctttcgctttcgatcacgtgctcatcatgggcagaataatgatgctgcttttggtgtggttcagaccatgaatgaaaaatggtgacgataatgagggtaatatttgaagtaactgaagatccacaaatcatgttcatgtgttttcttaaaaaaaaaaaaaaattaccaaaaagaagtctgttacaatgttttaacagaacagatgctgcttaagagtacaaacagatttttaacccccaaaaaaagaaaaaaggaaaaaagtttgagtggtggtggttgtaatcattaagggtactgtaatggaatattaatgattcccagtgggaatttatattgaaatttattttcaatttgatcatgaagaagtgctacagaatttcctattcagatgcatccatagacgtttgaatgtttgtatgtttggagcatttttatgttatgttatgttatgttatgttatgttatgttatgttatgttatgttatgttgagaca

SEQ ID NO: 14 - DNA, 3150 bp, Homo sapiens
catgactcaaaaagattcctttccccctaagaggtactgagcctatagaaatactctgaatgtgagtgagtcaactgaattttaaggctgtcggtggaaccatggggctgagtcacgtctgcccacagctgctgctgttcgcatccctgggcactgaggcctgaaactccaccctggcagggaccagcccgacccccctggaggaaatggccgggcagtttcagcagcagcagatgaaaacttccttcctcttcatccagctgcgggctcctccagcctgcactctccccgccccgtctccagcggcaaccccagggggcctggaggagggacacagtttcccaagtcccaggacaggcctcttggcaggctgggacctcaggcgcacacagggctcagctgcccctcctttgaggctgctgcagaaggcaggccctgagacggaggaatcagctgctttcacttgctctgctccaaaggaaaagaaggaagggaggaaaaaatcccaggatccggacgtaagcaggggtggtgattgcagatccccacatcacaggcattgccaggcccctgcctccaagacactgggctggctacagcccctggcatggaggcttcctagcccagctcccatcatgagtgatgaaagcagcagtccctccatgggctggaagcactggccagtcacttctgccacccaggatctgtggggcatggacccccgatgcagggatgccttgggatgctcccctccaagggctgtcctggtccacgctgcagatggagcggaaaggactgtgctgaggagaggcgccgagacctgccaaatactccccaggagctgtaaggaggccacaggtaccacagcgcaggcgacaagggcatggctctacaggtactgtccagctgtgcacaccagcaagggctgcccagccccgcctgccactctgcctctcaaggcagagacatttgtttgggtgaacaatgcatctgcacattcccagagtgttgccaaggccaaatatgaatttttatttggcagatctgaagggaaagctccagatactagtgatcatggaggaagcactttactcccaccaaatgtcacaaatgaatttccagaatatgggaccatggaggaaggtggagaaggcctaagggcttctctggaatttgatggtgaggctctgccatgccacccacaagagcagcagggtgtccagcctcttactggctgccactctgggctcgacagtgttacagaaggaccaaaagatgtcagagaggccccctctcaaagtcatctcaaggaacaaagtttacagcccattgactctttgatttcagctctgaaagccacagaagccagaatcatttccggaacattacaggctacaaaggtactggaccaagatgctgtttctagtttttcagttcagcaggtggaaaaagagctggacactgccagtcgtaaaacacagagagtcaacaaaacgctccctgctggccaaaaaaatttaccagaaatacctctttcagctgaagtaacaacggaggaaagtttttatttgagcatccagaaagatctcaccgcgctgttaactggagacactcaggcagagatttcccagataatgaataatgggaggaaaggggctgtctgtgtgcaggagccatcttgtcctttggcctccctcgggagctcagcagtgacctgccactctgcaggcagtgttggtttcttgaaagagcagaggtctgctcttgggagagagcacccagggggatgtgatcgaagcagctccatgggacgcccaggccgggtcaaacatgtggaatttcaaggagtggaaatactgtggacaggaggagacaagagagagacccagcatcctatagattttgagacatcactgcaaagaacagcctctcctgacagcaaagagtcttccaaagtgccacgccatctcatctcatcagctggtttgtgtaattcaagtagtttaactgagaatgtttgggatgaatcctggaaagctccttcagagaggcctggcactagctcggggacattttcccctgtgcgtcttgatgagagtggagaggatgaagtcttcctacaggaaaacaaacagcatcttgagaagacacctaaaccagagagagacagggaaaggatcagcgaacaagaggagcacgttaagggggaagatgaagacatccttgggcctggatatacggaggactccaccgacgtgtacagctcccagtttgaaaccattttggacaacacttctttatactacagtgcagagtccctggagacattatactcagagcctgatagctattttagctttgaaatgcccctcactccaatgatacaacagcgcattaaagaaggtggtcagttcttggagaggacatcagggggaggacatcaggatatcctgagtgtgtctgcagatggtggcatcgtgatgggctattctagtggcgtcaccaatgggctgaatgatgccagcgactccatctacacgaaaggcaccccggagattgctttctggggaagcaatgctggggtgaaaacaacacggctagaagctcattctgaaatggggagcactgaaattttggaaaaggagaccccagaaaatctcagtaatggtaccagcagcaatgtggaagcagccaaaaggttggccaaacgcctttatcagctggacagattcaaaagatcagatgttgcaaaacaccttggcaagaacaacgaatttagcaaactagttgcagaagaatatctgaagttttttgattttacaggaatgacgctggatcagtcactcaggtatttctttaaagcattctctcttgtgggagaaactcaagaacgagagagagttttaatacacttctccaatagatatttttattgtaacccagataccattgcttcacaagatggagtccattgccttacctgtgcaataatgcttcttaataccgatctacatggccaccggtggtggcttttgcagccgtagccaagattaaggctcaggatctttgaggcaagaaggaagaggagctgctaagacagctggacaacctgaaggtagacctgtcccagatgtatgtcgccgaagtgac

SEQ ID NO: 15 - DNA, 2309 bp, Homo sapiens
aaagagcacgcggcgctggccgccggcactcgcgccctgaggctgcggccccggagcgcccggcggcggtttcggcgcgcggccgggctggcgatggaagatggaaggaaggagcgcagcggcagagacatttgtttgggtgaacaatgcatctgcacattcccagagtgttgccaaggccaaatatgaatttttatttggcagatctgaagggaaagctccagatactagtgatcatggaggaagcactttactcccaccaaatgtcacaaatgaatttccagaatatgggaccatggaggaaggtggagaaggcctaagggcttctctggaatttgatggtgaggctctgccatgccacccacaagagcagcagggtgtccagcctcttactggctgccactctgggctcgacagtgttacagaaggaccaaaagatgtcagagaggccccctctcaaagtcatctcaaggaacaaagtttacagcccattgactctttgatttcagctctgaaagccacagaagccagaatcatttccggaacattacaggctacaaaggtactggaccaagatgctgtttctagtttttcagttcagcaggtggaaaaagagctggacactgccagtcgtaaaacacagagagtcaacaaaacgctccctgctggccaaaaaaatttaccagaaatacctctttcagctgaagtaacaacggaggaaagtttttatttgagcatccagaaagatctcaccgcgctgttaactggagacactcaggcagagatttcccagataatgaataatgggaggaaaggggctgtctgtgtgcaggagccatcttgtcctttggcctccctcgggagctcagcagtgacctgccactctgcaggcagtgttggtttcttgaaagagcagaggtctgctcttgggagagagcacccagggggatgtgatcgaagcagctccatgggacgcccaggccgggtcaaacatgtggaatttcaaggagtggaaatactgtggacaggaggagacaagagagagacccagcatcctatagattttgagacatcactgcaaagaacagcctctcctgacagcaaagagtcttccaaagtgccacgccatctcatctcatcagctggtttgtgtaattcaagtagtttaactgagaatgtttgggatgaatcctggaaagctccttcagagaggcctggcactagctcggggacattttcccctgtgcgtcttgatgagagtggagaggatgaagtcttcctacaggaaaacaaacagcatcttgagaagacacctaaaccagagagagacagggaaaggatcagcgaacaagaggagcacgttaagggggaagatgaagacatccttgggcctggatatacggaggactccaccgacgtgtacagctcccagtttgaaaccattttggacaacacttctttatactacagtgcagagtccctggagacattatactcagagcctgatagctattttagctttgaaatgcccctcactccaatgatacaacagcgcattaaagaaggtggtcagttcttggagaggacatcagggggaggacatcaggatatcctgagtgtgtctgcagatggtggcatcgtgatgggctattctagtggcgtcaccaatgggctgaatgatgccagcgactccatctacacgaaaggcaccccggagattgctttctggggaagcaatgctggggtgaaaacaacacggctagaagctcattctgaaatggggagcactgaaattttggaaaaggagaccccagaaaatctcagtaatggtaccagcagcaatgtggaagcagccaaaaggttggccaaacgcctttatcagctggacagattcaaaagatcagatgttgcaaaacaccttggcaagaacaacgaatttagcaaactagttgcagaagaatatctgaagttttttgattttacaggaatgacgctggatcagtcactcaggtatttctttaaagcattctctcttgtgggagaaactcaagaacgagagagagttttaatacacttctccaatagatatttttattgtaacccagataccattgcttcacaagatggagtccattgccttacctgtgcaataatgcttcttaataccgatctacatggccaccggtggtggcttttgcagccgtagccaagattaaggctcaggatctttgaggcaagaaggaagaggagctgctaagacagctggacaacctgaaggtagacctgtcccagatgtatgtcgccgaagt

SEQ ID NO: 16 - DNA, 10497 bp, Homo sapiens
taatattaaagaatggagcttaaattgaaacttcaagagctgattgattggatcggcttgccatttttggagtgagcacatgtgctggatgggagtgaggtagtgccaggacctaggagaagcacatttaagcaaatattcttgtgctgtaaactttaaaatacctgaacctggtcatctgacatggatttttttatttgagaagatgagatgtacatggggttaatatactagggaggtcagcatatgacttttccgtggtgaatttcattctgaaatgtcagtgttctctgaaagtcataaaacatgagtgcaagctgttttctgagttcatctctgatatgcagcttcttgaggcagatagttgggaattgcttagtggttcacactgatagcttatgtcatttaggtcaggaggcagagactgtcgctagggagatattggcgtaggagggacagtttgacacaggacatcacagccaggtcacagacttttgccattttaagagttgaatttgaggatgattctactttattctcgcaccagcaatgctggggtgaaaacaacacggctagaagctcattctgaaatggggagcactgaaattttggaaaaggagaccccagaaaatctcagtaatggtaccagcagcaatgtggaagcagccaaaaggttggccaaacgcctttatcagctggacagattcaaaagatcagatgttgcaaaacaccttggcaagaacaacgaatttagcaaactagttgcagaagaatatctgaagttttttgattttacaggaatgacgctggatcagtcactcaggtatttctttaaagcattctctcttgtgggagaaactcaagaacgagagagagttttaatacacttctccaatagatatttttattgtaacccagataccattgcttcacaagatggagtccattgccttacctgtgcaataatgcttcttaataccgatctacatggccacaatattggaaagaagatgacctgtcaggagttcattgcaaatctgcaaggggtaaatgagggtgttgatttctccaaggatctgctgaaagctctgtacaactcaatcaagaatgagaagcttgaatgggcagtagatgatgaagagaaaaaaaagtctccctcagaaagtactgaggagaaagctaacggaacacatccaaagaccatcagtcgtattggaagtactactaacccatttttggacattcctcatgatccaaatgctgctgtgtacaaaagtggattcttggctcggaaaattcatgcagatatggatggaaagaagactccaagaggaaaacgaggatggaaaaccttttatgctgtactgaagggaacagttctttacttgcaaaaggatgaatacaagccagaaaaggccttgtctgaagaggacttgaaaaacgctgtgagtgtgcaccacgcattggcatccaaggccacggactatgagaagaaaccaaacgtgtttaaacttaaaactgccgactggagggtcttgctttttcaaactcagagcccagaggaaatgcaagggtggataaacaaaatcaattgtgtggcagctgtattttctgcaccaccatttccagcagcaatcggctctcagaagaagtttagccgcccacttctgcctgccactacaacaaaactgtctcaggaggagcaactgaagtcacatgaaagtaagctgaagcagatcaccaccgagctggccgagcaccgctcatatccccccgacaagaaggtcaaagccaaggacgtcgatgagtacaaactgaaagaccactatctggagtttgagaaaacccgctatgaaatgtatgtcagcattctcaaggaaggaggcaaagagctactgagtaacgatgaaagcgaggctgcaggactgaagaagtcgcactcgagtccttcgctgaacccggatacttctccaatcactgccaaagtcaagcgtaacgtgtcagagaggaaggatcaccgacctgaaacaccaagcattaagcaaaaagttacttagagtccatctgcggccaggaagtgctggtcatggagcaaaatagggtttttcaagatctttctggtaatccgtgaatatatttaaaaaaaaaaagtctgtgacaaaacggtgcattagtaattttttctattgtatatttttgttagtttctgtacagattgtctttgctcttgatttcttttgctttgatgatttttgcaacttgatagctaatgcaccttttctgtgaggaggaggggatcgtgatttcagaatgaattatgtatcccttctcttttggttttctcttgtttgcagtctgctcagttgttttatgtattctcatatcaactgttaaacttttttttaaggttaaagaatttaatccattgtgaaacacttaactggacaaactgtagttttagtaaattctagctggagttaatatacgcctttatatgtgaaatcttgcccagtcacagaggtagaattgagcactcacagatgctccagtaagaatcacagtgctgggaatctagttgctccaatatgaggcagcttcatgtgcagcttagcacttgttgttgagatcggaccctgctggaagcagggaaaagaagcgtgaagatcgtaggattgagaacttagggaagcacattagcttgcttgaagtgctgattccatttcagccaagcaagggaaagaggaagtggagtcattttgcctttgaaggctgaggaaagattgatacccagttaattttgtttgctaaaggatgggggcaataatcggcccttgaggagctgcagcagtaggcatgtgctcagtctgcaggaattgttacctcactcccacagggtctagactagaaatccatcatctctatcgttgatatccttccatccaggaatagatttttcttactctacatatgtgtgtgtgcgtgcgtgtgtgtgcgtgtgtgggcatggggttgtgtcctggttgtgatattgaggtcttccttcctaacaaattaatactaaaatgaaacagcttttcttgtgtccttaagacaaaataaggaaggaaaacgtagctgcagttgtccacgatggatattggttctttaaaatatatctgaaagtagtagtcagaatgaattatggttggaaaactgaggaatcttctggttgcaggtgcaaagtgactttgtttattcttgtctcagtctccttgatagccacttcactctgctactactcaactttctcctaaaaatacttcatctattttcagtcctttctttctgtctactcaaaatggttctattaactttgcagtcatgagcttgttccagttacagtccctttgaagttcagggtgataaacagaatattcttctgtagaggaagagaaaggagtgaaagtttagcccactgagacctagagctttgtgatttcctaaccttgaaactctgtaatccctaaagttaaaatctccgcaagtggcacaacttcagaactaatagtatcactttgatttttctttttcctcccttagaaagtttctctagttctatagtttatttgttgaaggtactatgaccaaagaatcagctgctctacaggaatagcatggttccagtgaattagagaaaacctgctgtaaagccatggtagtgtctaagtggtatgttattatgatgtactagcatttatttacagaattatttattaacgtttacttccttcccctctgtaaatgtccatgactattgcccagagaaggcttacccctctctagggttgcagttgctttctttgtaataagtattttgccacacctgtaaaaaaaaaaacctcacttttaactctctgccttgtttgggtaaaggcagtaactaagtttatgtttcagaactgcaaaacaaacaggatagttaccaatatggcccatgtatcagattgatttttgtagcctctcactgaatccaacatatccacaagcaagttatctgtctttctacctgataatctaaattatcaggatatttgttttctgcctaaatgtttatactaagccgaggggagagaggtacctagaccatgtcatctacaagcttcagtaactaaagaaaaaggaacttccctgagtggcttgaatgtgtttgcccacagtctatatctatgtatatagaatgtctgtatgtattttacttatttaatatacattgaatggtaccttgctacagtatttctgacatttagagtagtgttgaaatactcggctagcatcagcaccactatagcactgtccgtgtcatatgagtcactaatattaactccagggacttctggataggctaatagatcattggatacgaagggctcttttgaagcttcagtataccatgtttgcatagtttatctttaaaaacaactttaaaggttcttttgtgagccaggatctcagactgccgtagcatgatgctgtccatctttagcgcatgggctgagaacacctcttccctgaggcttctgaaggttgctgtctgtcatgagtgcatgaaggaggccaagagtttatgctatgggaggaaacagtcactgatttgcctagattctgagagtctggcccatagccaaccacattttcctttgggataatttatttcctgtggcatctagccagaagaaattgaggatgtttcctttcacagctgctccaagcctgttgcccaattcacggtacaagggagcaccccttccctttcctctgaaggtacgccacccacctccgtcgcccacctcagcgcccaggagccttgggacttccttccatatgataaatcattcttcttcacgtcaatacacttcatattaatttctagtacagaaaatcttgacagctatcagaatgccttggtcatagtgttgttgcaaaattgaccatacaggtggcccatgtataaaatctgaattttaggggtttgtccccacctcgcatgctggcttttacagggaggtgtctgggattcctcattagcaatcaaaacttaattactgggatgcagagtccttactttatcgccagcccgtaggcatttctgaagtgcacttttttgaaacatcattttgctaactctcagcagtgtctaattaaactgagcaatacttttgtgaattttaattaatctcagcaaaaccatgatgggagagagtcctctgatggaaatgtagtccctggattatgtgtaacctttttattcctcttagatgcagaggatagaaagcattttttggtgcagtggtcttgtggcaaacacaagaccctctatgcgtctccaactgttatcctaatctagaaaatgaggactggcccctgggcaaaagtgacatgaggaatttactctggaagaggaaaatctgggtggctttccaaggctaagataggtttgtatttcaccctgtggccaagctacagaacttctgagattgtggaagaatttttgcaaccagcagggaaagaggcctcttactgcctaaacacaaagttacactgagcttttctactgtcctttgcctattgctccctctatcatgtaaagatctgggaaggatgagaggcagggcctgcttgtcatgagctgcactcttttctttttaactaatcattgacaattggaagaaaattgacgttaaagaagtttctccattgtcttactaacaaaaccttttgggtttcattaattgtccttgaaattgagttcctttggcatttttccttgcagtcatcagttaagcatgttgcatcctgaattcacagaagtttagctttgcaggtttgaatctctgtaatttaactcccgtggacttggtcgagttttcagcaggttgggagccacctctcttcatttcagcagtgagtcatcccttgacttttcaaatgacagaattttttccaattgtaaaattagcactgtaaaacaaagaaccaaagtggcatcctaagagttgttaaacctgaagtctagtttatgaggaattgtccaagttggagtttaaatagtatctgcttttgtctcaaagcatctaagttattctgacagaaaatggtaagtcagctttgcaggcagatgcgcctctgggcctcctaccttgctccacagctttctggccatcttgtctcccaggccatgccactgctctgccacatgtcagcaaatttctttccaccagtcttatagcatcttacatgatcaaatcatcacagaataaccccgtgatagattattgatagcaatagagaggggctttgtcactgatttttctctcagattccttttccatctctcatccataaaggaaggactgaaatccaaaggcattctccttttgtacctacagtatccagaacccacgtgggcagccttctgcttatgacaataattggcccattgcatgcagagagaatgtcttcatagagagaatgtcattaaatacttgaatctgcatgacagtttgacttgaatgcaacagcaggaaaattttgcaagttacataattgtatatacagtaggttttcttaagtctcttcggttcatcctttgtaatttgtgtgtgtatctgtagtattgcaggcttttggagactattcttacaggcagtatgtcagtcatcaaagaaaatgctgtcacctgccattgttgtatttgtgggtatttatagttgtatgtatgtaaatgcatcagtgtgtagattgcatatcagtgtatggtacatgtacatcaaaattatttttgtccttaatcagtgtgatatgaaaagcaagtacaacctcataggactgattatataatgaagttgttgagagtatatatagtggtattgttttattaaacttaaactcaaataatattttgattaaaatttttaataagactttatgctagaaaattctttgagctttgaatcaccagggcaaaaatgactttcaactaaccttgtgaatcttttgcagtgtactgtgtgcaataccaagggcatagctccctgtaatttgggaaatacagaaagaaaagaaaaaaaaaaaaaaaggcagcctgtgcagtcttagtaactttagtattaagagcacttaaagtcaaactgacaattttgggcttattacaaaatgtgatgctttaaagcacacgttctttattgttgttgtaattagtccataaaaaatatagctttcggaagaattaagtacccaccatatcatttatgtatttgtgtatgttttacgggagatcaaaccactctcgtggtgccgcatccgtactcgcttgacttggaagaaatatcacaagcactaaagtatatcagggcatcccaggattgggtactgtatcctaggtttgcagttgcagaaattagcatctagtgtcacaggtaaaagaatttcaggaccaggtttaaactttattttaaatatttttatacttaggtctctttttcctgcctctccccaaagaagagccactggccttagttgtttgagcttactgcttatattatagagtgtaaataggtaactagagactaaaattttattaaccagcatgtttggtatatttaaagcagtgactgagtgtgtttgagtgagtggctgagtgcagtgtcttttgtttaaacacactgcctcgtgtctttgtagctgattcagagagtttgaattgtggggtgggagactaacttcagctccaggctgcagtaatgtgttggtagttacacttgaggcatttttttgttgttgttaattaactctatagtctcaaactatttttgcaaatatatcatttttcctaattggttcttgacgtgcagtggactggctctgtgaatgattggcagggtcttagttttgcgagagtatttccttctaagaattattgtgatctgcagaaacagccatttgattcaaaaatcatgtagaaaaggagtaggagaagcaaaacgtttcatttttgggccttaaccatttgaaatgtttggactttaaacataaagccatggagtttataaagccaagtaaccatttgatatggataataatatctactctagagagagtatatatatgcacattgatttttaatgctgttaagatacttttgtaaaactgtaggaacaagagtaattagaccaaattgaagcttaggggacagtaaagtggttgctttccatttagggtaaccatgcatgtggttagtcctctcctcctgagattcagaaccagttgactgtccccttaggtgtataaggagaaaagttgacatgtctgggacctctgacatgtgtacacatgcttgcacacatgcacacacagtgaatgttttaagttatacaaacataagaccttaagatgcaaagagccagaatattctaaagaggtgatgaacagagggggtggaaactgcatcacagatgttttccaagggccagggtggaatctgagctctagtgtctgactttgagatgcattatatttttaacacataaatgaggggatccatatcacattctttcttgtggaccaccaaattgaaggctttcttgtaattcacaagcagcagctctccagcatctctccgtagcctgggtgaagtcccagaagctggtgtgcatcattttccaaggtggcagagctgcttgctctgcagatcattcctttgagagaggagtacaagtgaagaaacaaggaggcacttcctgtaggagcactgatgtgccttgtccacactcccctctgagctttactggtaagagagctccgactgaacatgctgagcagttgagcacttttccatcagcaacaacagcgaggatggaaatggaaaggaaccgaactaaaatgcatttccctttgcagggcagagagctaagctcttaggaatagtgttatagaaataagcaccctaacttcaattcctgaaaatgttggttaatggagagaattttggagtttcacttaatattttcccatcggtcgccataaataagtcttcaggcgctcctagaagagtcccagcccaaggctcgattaaggaccacactgcaggtctgaggctcactgctctgagtcctgaacaccagagccctgcagagagtggtgataacacatcatctctgcaaagaggaacctctcccccggccgccacttcactcaggcttctactgagcagcaaggacagcctgggtttcaaatgccacttcccctgctttagggatccaggtgtcctgatagcgtgaccctgctgaggcaaggtatcaactccgagagtgactgagtcactgagcgtggcacatgaacaaacgtcatgacaaagattctctgagtgaagttaacaccacgtattttacctttgcaaaaaacaaactggcaccctgagttctaactacggacggacgatatctttgcctccacacccagattcctggaaatggctaacgtttcctttctaggggaagggtcgaggaatactcaagtgctagcttagcagctttgttcagtccagatcagagctgttaggtaaaggcctaaccacctccctgcagtctcttatatctcaagctttaggaacccatttctaaatgtacactagcggagaatttatattgtcagccttgattaccataggacaggcagaaaggcgataatttgtatcttttaatataaaagaagcttttaacttttccagcctattataataactgagttatattcactgtggctcaaactaattggcattgtggaacatttctttaccttcaaagttttctccaccaatcatttcagttctattgcagtcctggtgccatatgtcccctgcaaattgtgaaagtaattagtgacaaaatagcagcctgctccttttcaatggcgaaactgtcggcattagcagttttgggtaagctggcggtactataacacgtactggaaacctgttcctcatcaccacctaccagattctggaaatgccgtcttctagaaaacgatggcgtttgtggtggtcttcttttgaaaggaacagtaatttgtgtggatattgttaaagtgtttaaagaatattttgacaattaagtttacattttacaattgctttattttttattaaaatagttgtatataaatattaccctatttcactgttgttcaagtaaatctaaaccttgtagacaagtgagtcatctgatatgtatagaagctgtgatatatagagtacatttattgtgtaaatgtttatgaatataattgttcctgtgtttttataagttggggatattttgttgttttacggcaacaaaatttattgcatttaaatggtttttatgtaatagaaatcacgcaaaatagtgaaggatttaaaatatgtatatgatacatgtaaatgtacaaactttagaaagaaataaatccaacaaatttcaatca

SEQ ID NO: 17 - DNA, 566000 bp, Homo sapiens
cctcggcctcccaaagtgctaagattacaggcctgagccactgcacccggccaactttttttataggtagaaggagtacactctaaaatcatgataaaaaagtaaatacataaaccagtaacatagttgtttatgatcaagtgttacatactatagtacgtattatcaagtattacgtaatatacataattgcatacaattgtatgtgcctggcagcatagtggtttgtttacaccagcatcatcggtgatgcactgtgctatgacattacgacagtgaccacatcactagatgacaggaatttttcagctccattttaatcttatgggaccacccatcactagccgaaatgtcatgtggtgtgtgaccttacatcagttttatgtttacaaagtattcctacatagattatcccatttgacctgcaaaacaattccataaggtaggaagggcagaaatttactccattgtgttaaaataatgtccactgaggttcaaatttgttgtgagtcacagctaaagattagttactccagaactcagacccatttccccgaccccaactcccttgctgaccctcctacatcccaattaattcctcagcccttaggtgctttcccatcagacaggaagcatgaaaacatgcatgtaattacccgttgcaggttaaaaaaattatacatttcatgaaacaactcaaattgttctgttgggtgaacaagttttctccaggataacatgtggatctaaattctaaaagtaactaacatttattttacagaaccgattaggtagcaggcaatatgctaaggaagccttttgcacctgcacttaatcttcacaacagcccttgaaagtagctatttttttttaacttttattttaagttcaggagtacacgtgcaggtttgttatataggtaaacttgtgtcctgggggtttgttgtacagattattttgtcacccagtattaagcctatacccaatagttatttttcctgatcctctccctcctcccactctccactctccaataggccccagtgtgtgttgttcccctctatgtgcccatgtgttctcatcacttagcttctacttatgagtgagaacatgcagtaattggttttctgttcttgtgttagtatatgaacacttttcaaaagaagacacacatgtggccaacaactatacgaaaaaagctcaacatcactgatcattagagaaacgcaaatcaaaaccacaataagataccatctcacatgtgtcagaatagctattattaaaaaggaagtagctattgttacttcatcttagagaagaggacctgattgtcaaaaaggccaagtaaattattgatatggtttgactatgtccccacccaaatctcatcttgaactgtagttcccataatcccccatgtgtcacaggagggatccaatgggaagtgacggaatcatgggggtggttacctccatgctgttctcgtgatattgagttctcacaagatctgatggttttataagaggcttttcccttctttgctctacacttctccttgctgccaccatgtgaaggacatgtttgcttccccttctgccatgattgtaagtttcatgaggcctccccagccctccagaactgtgagtcaattaaacctctttcctttataaattactcagtctctagtatgtctttatcagcagcatgagaccagactaatacacttgcctaaggtcacacagccacacagtggaagcagggctaagaaatgtctgtgtggcaccaaagtctgtgctctcaaatcactctgctgtttactcatgtttctctggcactttcccccacatctcacacagagctcccaccccctaaatgcgcctcctaatacttaagggtgtcccaaggaaatgcgttacatgaatcctccaagtcagccctcctgtcagctctcaagtgtcatccaccatttatttacccttctcctatttcagtccacacaacccagaaatgaaatattgggcagtaatccccactgtggtgagcttgcaaataaaaagaagacagaagtgccctggacacgctaccagcaccaccatggtttccttggtactttacttcatgtggtttagaagttggatgtttgaaatggaaagaggtgaaggagtgaaacttctcatccgacagctttttaaagcccctgcctacttggggcagttgtgccttccctgagcttcacattccttaactgcaacatagaaatgatgccacctacttcacaggattgtgctgtgccttgaatgaaatacactatgcaaagcccctgatgtcatgcttggtaccttcagaaggtttcttctcacccaaattcctgttccctatgaagacatagtttcccatgttactggcagttaatcagtcaacacgcagtactgtttgttgagcgattacaatgttcagacaagttcttgtatagaagagtgtgaaaattacctatagaggactagtcatcacttatgtaaaatgttttatgaacattaatgtaatgagatcaacatacaattacagttagacataatatggttttgtcaaaattttctttgtagatgtgataaaaaggattatagcagccggtgcctggcctaaacagatttgagcacatttctaaatgagatgtagattgagtcacttgccagctattggaaatgtgggcaaaacctccttgacctttggtgaaaaaacttttaaagtatgaagacgtttaacaaggaaaactatcataagactccaactgggcatcctggcatcctgagaatttccaaggattcagcctggtcagccacggtcagccaaggccagtggcccctgatgcctcaggggtgctgcccgtgtgcggggatactgaggagtcagggagggagaattcacccaggcttcacatgatgctgcatgcagagcaaggaagttctagaccacatgctcactttgttttggaggatgatttcctggttcccttttagtcaagttatttcacattgacgaagactagagctttctcacacctgccttctttcctcctcaggtacagggtcagcatgactcaaaaagattcctttccccctaagaggtactgagcctatagaaatactctgaatgtgagtgagtcaactgaattttaaggtgatttcttttcttcttccttttgtctcattttttatttattatacttttcaattgcctattacaatttgctaaaaagaaatgatctccatttttaaaaagcactgccatgttctcacaagttaaaagattagattatttttttctttcctctaattaagatgggctaaattatttttcaaaacaacaaaaacaacaacaacaaaaagcccttccagcctgatttgttacctggatttttttttttaatcttatttcttctttctctcttctttcatgtttttcttttttcttagttttttctttctttttcttcctttctttccttctttctttctctctctttctttctttttcttccttccttccttcctctctttttctttttcccttacttccttcttccttccctccctccctccctccttccttccttccttccctccttccttctttcttccttttctctctcttactttctttgatgctaagtgtcttctgcacagctgcaacaatataccactttcttttcattttgtggggtaataccaaatttctttcatgctgctctaagaaaataccatagactgggtaatttataaagaagtgaaatttggtttctcacagttctggggactgggaagtccaagatcaaggcacctggtgcctcgtctggtgaggactttgtcctctggaggggaggaatactgtgtcctcattgggtggaaggcagaagggcaacctactgctcaacagctgtgtgaaacttcttttataagggtcttaatcccattcatgaaggaaggcaccttcaggatccaattgcctctgaaaggtcccacctgttaatactatcacattggcagcaccagaattttggaggagacacaaaccatgacaccaagtattttgatgtgggacctctcctacagaacccataaatgaccacagatttaaagtgcaaactcatgaaaacattaaagttgcttacaactgtttgttgcgcactttatcctagaggtcttaaaagtatttagtaaaaataatgcagacaaagtagatgaaaagtacacttcaaagcttattggaggcttcatttataaaccagtgtctcacaggtcagtcaccaagtaacaagaacagctaacacagaatttaggattaaattatgaaatgaatagtgttttcatttcaaataggaggaagggggcagtgaagaaaaagtgattccatgtagatacacaaaggtgagagggggccggccgcagtggctcacacctgtaatcccagcactttgggaggccgaggtggggcggatggatcacctgaggtcaggagttcaagaccagcctggccaacatggcaaaaccccgtctctactaaaaagtacaaaaattaggtgggtgcggtggcgcgtgcctgtaatcccagctgttccggaggctgaggcagcagaatcactaaaacctgggaggcggaggttgcattgagctgaaatcacaccactacactccaaccagaacaatagagccagactctgtctcaacaaaaacaaaaacaaagttgagaagggttgtcttgactgtcctcactgtcacccctcacttgtagattattctccactaatatctttttgtgattctgtgatataagtgcaaagtccagctccatggccaagatcattatctgacccccctattttaagactcccctgggtgctgaagacatgttgtttgcttcctcaggctgtcggtggaaccatggggctgagtcacgtctgcccacagctgctgctgttcgcatccctgggcactgaggcctgaaactccaccctggcagggaccagcccgacccccctggaggaaatggccgggcagtttcagcagcagcagatgaaaacttccttcctcttcatccagctgcgggctcctccagcctgcactctccccgccccgtctccagcggcaaccccagggggcctggaggagggacacagtttcccaagtcccaggacaggcctcttggcaggctgggacctcaggcgcacacagggctcagctgcccctcctttgaggctgctgcagaaggcaggccctgagacggaggaatcagctgctttcacttgctctgctccaaaggaaaagaaggaagggaggaaaaaatcccaggatccggacgtaagcaggggtggtgattgcagatccccacatcacaggcattgccaggcccctgcctccaagacactgggctggctacagcccctggcatggaggcttcctagcccagctcccatcatgagtgatgaaagcagcagtccctccatgggctggaagcactggccagtcacttctgccacccaggatctgtggggcatggacccccgatgcagggatgccttgggatgctcccctccaagggctgtcctggtccacgctgcagatggagcggaaaggactgtgctgaggagaggcgccgagacctgccaaatactccccaggagctgtaaggaggccacaggtaccacagcgcaggcgacaagggcatggctctacaggtactgtccagctgtgcacaccagcaagggctgcccagccccgcctgccactctgcctctcaaggtaagaactcgcatgtcctgaatcccagcagaagaaagggagccaggggacagacgtgccaccctggcctccaatttctggcgttggttctctcctctgcttagatgggccacacctcaacagcagaggtacccacgagccgcagccttcccaggcctggcatttgctctgtcctctgccaccttccaggccaccagaaacattttgtttggaagaaggcaaggattaactatttcccaagatttctgccaaagatgggaaaagaaaagtcaggcatactttataggggaacaccagaaggaaggacaaaggaggtacccagacatttattgggtcctgtgatgtgctaggcattttctcacatccccttactcatcttaaccactttgagaaatagagctccacagctccagtttcagatgaggggatggagatgtgactgggcaaacatcctccccacccttgcagaaacacaagggcaaaagcaaagcttgttctccagaatgggcattgggaacaatgggggaggctccagggagctgtggaggtttccagaaccggagcacagccttggaactcagccacaccctactgtcatccatgaacacctgactttctagggctctcatgtaccttccatctccccaacacacctagaccaccaccaaatggatgtgcagcctgggacaggagcctccattccccatcaggaagggaaaggcagccctgtgtggcctccaaggtcttttccagctctgtgggctcctgtttccagctctacgggctctgcctctgatcatggccttgcctgcccttgttgttagcatctcacactccgcacttctggcccagccttcccgttgttcttgtgcctgcagcccaccctctccacccagctcaggtgcactgttctcaaattgggtggacaaaacttaaaattatgcattcagctttcttttctcacagtgtgggcatcttgctatcctttgcatgtgtgtgagcatgagggtggaggtgaggaagggtgtggagggtggtgggatgagacggaaggaagagggagtcattggagtgttgagggttagcatggacaggaatctcagggaagtcacagaagaaatgaatgaaattcacagcatctggcaggggcctcccatgggcttagagggggtactgcgtcatccaaacaccatgccctctcctgcaggcttctcacagcacccttccttcccttttctctttttaacaagggcctgcgtagccacagttaagaaacggggagaaagctctccagagtagcgctcttggaggaagagatgctagcatgcttccttaagaaatagttcacattccatcctaattcttgcatctctcatttcctaccgggatttaggaggaatgacatactcctgcatcagagcccatctctgtatgtggggtcacacagttattgtttgtgtacttcagtgctggcctgatgacttgaaaaccccatcttttcccactctcccctcccgccttcgggggataagctgaagcctcagagctgttgccatttctctgggaagaggcactttgggaattggtccaagtgtgtggatctcacccttgtccacctaattcagagggctgcaaatgggaccccgacatctgctcggtctaagttaaaggttggaggatttctggctaaaaagttagaagccccaagtccaagtccttattgagagcaacccgccagagctctctgaggctcagtttttccaccatgaaaacactgatgacgtcccctgcttcacattgcaatggagatttgcggactaaagtgaaaggggccctcagtagtcctaagggagaaaagaggagaagccaaatcagtgagacaccaggtaggaccagggaacccatggagtcagaggtggtcagacaatgtgattccctctgccatggggagagaggagttgggaagttagcacccttagatcctgtaggtgccgtacggctatcactaaccagggaacccctgcccagggttgggtgttaaacaaagcagcacaatagtttttccatgtgtccagccctggacagattaaggtgctatctagacttgaaagatgagtgtgtgagaattactcaatcctttcatgttttagaatgtagctatatgaattgtcgcaaagtatcaaaaagctgattaaaatataatatcttcttgaccactgtggatgctaatgccctcgatcccccataatggaagctttcagtcgatgaacttatggaaaatgtgctcagttatgtttattaaagtgaaacgttggttacagggaaggaaactccattcctacacgtgtacagtagagttgaggtcctagtgtcaatttggaaaatcctggatctgaagagtaaactttcttctttgcaggattcaaaatggctgaatttattctctcagtgatgaaacatcacaggctccatagtaaaaaatcttggcttgcatctttccaagtattataaggaatgaagaacaaatcttcattggttggttcttagtttgttctatgaccaggctttagtaaaagtaatcagagcgttctgtgacctggatggcttccgttgcattatttcctcttatgaaaatctcgaaattctgcaaggatgtatgttattatcaccccacttcactcgtgaaaggacagatgcttgcagatagtaagcaactccatgggactaggatgaagcagcttgggcccagccctcaagttgtctacccccagtccagggctctgtctgccttctttcactgtctttccagctggcaaaatttccttggaagtaaccctacatttcctgaggcctggtggtctgtactgcactcctaattcctctggtggagagggtgggagaaagacactcaagactttaggtctagtgacctaaccttgtacgaatgagtccagccagctttctagaagcagtgaaggcctaggtgttggggacgtggagtctcagctcagggtggtgccaacggacggctctaacatttctgtggtgagtctgtcagtgtgaatcagagaatattctatgggccgggaccagagcctgccctaaccatctcccaggcctcatgtgctgctgcccctctgtgggaacccagggaactgttcacatttgatttgaacttggggctaaagataagaggataaggaaagcagacccaactcaaaagacaggggggaaaagctttctctatcatcgtttcgggacatttccacatcttaaatttttttttgctaggtcttcatattttacatattttgtgtcttaaaatggcagtgacttttggtatataagcagccttagaaaattagtgaaataagttttttaatgtccctcatttttactgacctcaattttatctatggccttaaatttgcgaaaagattgactgctctattttggtcttcctttctcccttcctacctcaccgttggtcctcaaaaccaattcactttttgagctttgatcactagcttgtaagactgttcagggtttaggaaacagcgaggaaatgagcatgacaggcaaggagccagccagggggtttgtgtgagagggagacaggcactgggacatcattcatttacctaatcaatggaaatgcaatggaggtctattttctcatgtgcagaccctgtctagcagactaggaaaaatagtgtgaattctctgtcttggactgttactccttaaaatcaaactaatgtctgaaatgtaaatctatgaagtacattaccttttgggtagaaagtttttgtttagttcacaagataacaaagaagctctggttttgctgacaaactagttctgtggcctctgacatctccctgaacaaagctagcttctctcattgtctccaggaaatctttctacctcaaaaattctataatacctatgcatctatgaatacagaaagggaatgaaactctttaaggaaagataagtattaaaacaatttattttggccaggcgcggtggcttacgcctgtaatcccagcactttgggaggctgaggctggcaaatcatttgaagtcaggagtctgagttcagcctgccaacatggtgaaaccccatttctactagaaatataaaaattagccaggcatggtggtgggtgcttgtaatctcagctactggggagtctaaggcaggagaatcgcttgaacccagaaggtggaggttgtaatgagccaagattgcaccactgcactccaacctggatgacagagctagactctgtctcaaaaaaaaaaaaaaaagctattttcttctatctcagcttatctctaaagattcattattttgtcaaatgacttcactacaggaaacttacctatagagtgagcttacctttcttagggaaaactgggatttccatgaggagcaagacattcaggtatgaaagagtcagtgctttctttgaacagtaatacaaattcccaccacagaattttggaccggtattgcaagccgtctgtcctgtaatggttctagttaaataaagtcccctattacgagttgaacattgactccctggtctacttaacccccaggaagcagtcacttacctcattaaaggtaaacatttcgttattcaagcctgtttgacttctggtctgtcataagtttaaaagttgtttttctcataaaatagtattctagataattctgtctttatattaattctacttggtgagtcatttagaattttataaaagaaactagaacaaagaaagagcatgcacaaatgctcacatagtaattttaacagatatatagattaaatgtgcagtgaaacatccattttaaaagaatgtggtatttaggagtcagtattgatgggattgaaaagcttatctttagttcattttacgctacgttggttttgacacagatgtcttgatttattacttgaataaataaagcctgagatagcagaatgggtttcaatcctttctcatcttgtgatttgccttagtgttcccatgacaacgttctcttgctctttttctctccttaccccatcctcaacattcacacacaggagtcctgtggatcattgtataggtgcaatcctcctggaagtttagcatctggatccacctataggaagcagagggccaagagtgcaaggacacctttacagctgtgtcccttgcaacatgttgaaaagcaattggattgggagctgggacacaggggctcaatgcaactccaataggtcttgtttttcatctctcctctgctatcttctgcttgcccattcttcagtcttctctgatccctctttctctttctgcccatctgcttgctcatctccctactccacagggaggaatttgaccagcaccactcccaggtttacatctctttctttagaagacaatccaggctaacactgaattctcttaggcctgcatccctgggaggagactttttgctctgatgtgggctggtacccactaagtctactatggtgggcacagaggtaggtgcggctcacattgtgctaacaggggtgctgagatcctgaagatggttacaccatggaggtctgggaaagggacaactcataaaggttgatggggagcagagagcagaggagaaaatacagacagccaacccagtcaatgcccagaaacacttgcagggagttgtcagctgagagtggaaagtgattgctttgtttaagtattctatctgagctctctccaatttaacattttgagattaaattatacattactgtataattaatatagaatctataaatgtactataaaattatacatgttatagactttggggagatttttaaaaacagcatcctttgactttgtaatatattagaatcaaatcattacctgatgtgatttataaatagatttgcttccacaatctgctacaggttatgatacggtaaaaattttatctttgaaagacttttgttttcctggcttggctcggtgactcatgcctgtaatcccagcgctttgggaggccgaggaaggaatctcagttgagcctgggagttcgaggctgcagcgagttgtgactgtgccactctactccagcctgggcaacggagcaagactgtgtctcaaaaagaacaaatttttttttccttgtagatttatagactataggatacaatgagacttacaaagacttagtgaaagcaggttgtatggtaatcaaatgactatcatggattccgcatgtggtctcttcaactttacattagttctctgggactcctgacccagtattccagaagtcagaacaccaaaaaggtggagattagccacatgccctgaattgggttatactgaaccttgaactgtaccttatgacttagcatgtctattaaataagcataaataagcaaatctatttataaatcacatcacgcaatgatttgatcctaatatattacaaagttcaaggatgttgtttttaaaaatctcccaaaagctataaaatgtatattagcttccctaaagtttgagagagctctgataaaacatttatacaaagcaatcggtttacactcttagctgacaactctctgcaagtgtttctaggcaaacgaaaaaggtgggcaaatgacagaatgacggctacatggagttgacgttgtcagataatggcagggctgcattttttttttaaggacgtccaccttccttccttctaaagtcatcagcagctatgactgttttttggctgcccttcatgttgtgcatatttcctgtgattatatttagtccattttaactttttagaatttaactttaaattttcaggatgtgtgattttgcattaacctttcaataaccaggtccagcagattatgaggtaaaaagctccagggaattattcaagcacttacaatgttatatcattggaaaatctcattttatctgcaaggagcttggctgctcttcattgagttctcactgattgtatgatgcagtatcaatgaaaatattaaaccatttatctcaggtcagagatatctcagagaagtctcaggagactttgttaacatagactcaatcttccccataaagcatttccaatatcctataacaacagcacaaataataaataaaaacaatggtgaaaggtagacggtaataaacaatcaagactaggaaaatatataaataaaagtcaaggtcaaggaaggatgaggttgagattagaaaagcaacccaaaagtccatcccataaaggcctcctacaaagctggtatgtttgacattcagacttaacaccgtgcttcctacctgcccaaggtcaaagagtcgcaccagtagctgtatagctctaattgtgagaagggtgaggagagaaggaagggagggaggaagggagggaggaagcatgcgggttcttttaacatgtcccacagaaattctctttaaaaaacaaattttgcttgacctttaaagtaacaatttaaaaacaacattttggataaaaacttttctaatgagcatttcatattcactgtgtttctgtttctttaaacatcatacacataacataatttaatctgataatataagtaatcactctaatcttgctgctggtacccaagtattgcttgctggtacccttaggtctttcagactatttgcccttatatttaataaaattttatatttgcatctctcccactagtactctgctctctgagctcttttttatttttagtagtttttcggtttcctctgttctggcctatctcctctcactattattcctatgcctacctctaacatccttttctaaatccactacaggccaggaaactagaaaacaaatttgtttctattgcaaggcaagtagatccagctctactctgtgctttaaacaacctataaaataaatattttcaactgaaataaatcattcctacttttcatgccatttgagaaagctcatggaaaaattcttacttttctcatcctcaatctttatttgtaagtgaaatttttcttagcatactctgcaaactgcccttccaccgtatttttattgagagcatcctccataacaacctatctttttatactgtttcgtgagccacttctggctggcgcctgcctttttttcatttattaggttgccttgtgttcgtagcctgtgaagctctttggagaaaaagtattacataaatccaattagaagctatatattcaaagtgagtgcaggaattacattgttgattacgtgtaagttaccatattcattattaaattaacttattaaatgtttctctgggtcctttataatccatacaacagaagattctttttctgctttctataagcctttagggcagataaacatacatgcaaagaggcattttgaaacatacggcatgaaacactggcagtatatttacaaaggtttaatactttagtcactgcaagcctacaatggggtaattactgtccaagttactatctgcacatcgtaatttaaggaaaaaagtgaccatttttattccattgagtcagaagagagcctcagtagagatgcacttcaggggccatcagggtgaaagaggaaaaagcttggtgaattgaaagaatgtaaagaggatttgagttttggacttctcctgagttcatgtgtgaatttcataattcattaggaaagaatatagcaacaatgtaatcatacatacatgcagtgaattggtctgaaacctgaaaattaagataaaggtttataggctgggtgcagtgcttcatgcctgtaatccgaacaatttgggaggccaaggtgggaggatcacttgaggccaggagtttgaaccagcctggccaactgagtaagagactatctctacaaggaaaataaatctactttaaaaattcgtaattaatggtcaggcatggtggttcatgcttgtaatcccagcactttgggaggccgaggtgggcggatcacttgaagtccggagttcgaggccagcctggccaacatggtgaaatcctgtctctactgaaaatacaaaaatattagccgggcatggtgtactgtgcctgtaatcccaactacttgggaggccgaggcaggaaagttgcttgaacctgggaggcagagtttgtagtgagctgagactgcaccactgtactccagtctgggaaaaagggcaagactccatctcaaaaaaaaaaatagtaattaattttcaaaagtatttctgagttaggccgggcacggtggctcactcctgtaatcccagcacgttgggaggccgaggcaggcggatcacaaggtcaggagatcgagaccatcctggctaacacggtgaaaccccgtctccactaaaaatacaaaaaattagcccggtgtggtggtgggcgcttgtagtcccagctactcgggaggctgaggcaggagaatggcgtgaacccgggaggcggagcttgcggtgagctgcgatcgcgtcactgcactccagcctgggccacagagcgagactccatctcaaaaaaaaaaaaaaaaaaaaaaaaaaatatatatatatatatatatgtatatatctgagttgtaaaattataccttttattcaaagtcataaaaataaactaaaaatagtagactacatgtttggaaaacaatacaatgtcatgaaatgaagtacatatttcagcataaaaaatatgcatcatttaagacaacactggagaatttgaaatccggattagaaaatctggacctagattgtgtgtctgtacatcacagagttgtggcaccccccggacccgggagatttcccctcatcctggaagatttcccttcccaggtgccaggcagtgatggcaactgaataaggccaccctgcaagacgttgctaagagacagcagaaacaccgcaatgggttctgtaaactcgatccaagccagtgatttgaagctgtttgctggtcagaccgtactgggagttggggagctgaggttgctttggggatactgctttggatgaggatcccagcgcaagactgcaatcttgaggcagcacataaacaattctgggctgcggggcgcggtggctcgggcctgtaatctcggcactttgggagggcgaggtgggcggatcacgaggtcaggagatcgagaccatcctggctaacacggtgaaacctcgtctctactaaaaatacaaaaaattagccaggcgtggtggcaggcgcctgtagtcccagctactcgggaagctgaggcggcagaatggcgtgaacccgggaggcggagcttgcagtgagccgagatcctaccactgcactccagcctgggcgacagagcgagattctgtctcaaaaaaaaaagaaaaagaaaaaaacacaattctgatgtttgaatagcaaatcagagcaggtgattcagttgagaataagcaggctgtgacccctgaactaaaatgccatttagaaatttgtgacccctcttataatatgtcagttcacaacagtcctgtacagattggcttttctgcctttttccctctcagacaagacaattattaagacctcttaggcctatctttttttttttttttttttttttttttttttttgagagacagtttcactctgtcgcccaggctggagtgcagtgtcgtgatctcggctcactgcaacctccacctcctgagttcaagcgattcttgttcctcagcctcccaagtagctgggattacatgggtgtgccaccatgctgggctcatttttgtattattggtagagatgggctttctccattttggccaggctggtctcaaactcccaaccccaagtgatccgcccgccttggcctcccagagtactgggattacaggtgtgagccaccgtgccctgccaggcctgtcttaatcatgaagcctgaccaaagaatttgtagcattaattccccacctcatcccttttcaggtttgcttggcctttgctgcaggtggaacagtctgtgccttatgggaaaaaaaatgggttatcattctgttaagaggcaagaaaaagaacaaaataagttattcatgaattacaagtatagcaggtataaaaatcaacattctcagataattaaccattttattatctttaataaaatctagccccaaatcctcgtactactggaccagcaagaaattcagtctcggatagtctcagggttccccatcctttatagttgggccaagggtcaggaaatttcaacggtacaaaagtattcatgcattttcacgttcacttgagtccttccacatgaactcagcacagtacagacttcagagccagatggaaaataaggattatgtgagttataatatgtaaagaacttggaattgagcctagcacagaatatgcagaccctggagagcctccctgctttgattgccagtcctccatccacccgaattttggctcaacagcctctcaccctaggctgcatgctttcaggtccaacagttccactgcttctgtgtcctggttgcatttgagcagctgggagcccgtggcctgggttttctctcttttctccatgtctgaatagaaatgatttttcttacccacctctctcatcttgaaatagaaagacgaaatgtattattttcatctaatcataattctgtgttctgtatacctaatgtcttaattctccataaattcatcatccactgcagttcagaacaagtgagactttgaaaacaagagtattattgaggcttagaaatgttcagaaaaccatccgggctccgtggctcagtcctataatcccagcactttgggaggccgaggtgggcggatcacgtgagctcaggagttcgagaccagcctgacaaacatggtgaaatcactagaaagttagctgggcgtggtggcgggcacctgtaacccaagctactggggaggctgagggaggagaattgcttgaacccaggaggtggaggctgcagtgagcagagatcgtgccactgcactctagcctgggcgacagagggagactccgtcacaaaaaaaaaaaaaagaagaaatattcaggaaaccaaaagagctctgtagagttggaagagtgaagttatgtgcatcagggtcctctaacaaggttaaaaagtagaaggcagaccaggcatggtggcttacgcctggaatcccagcactttgggaggccgaggcgagtggattgcctgaggtcaggagttccagaccagcctgaccaacatagtgaaatcccatctctactaaaaatacaaaaattagccgggtgtggtggcaggtgcctgtaatcccagatactcgggagggtgaggcaggagaatctcttgaacctgggaggcggaggctgcagtgagccattgcactccagcctgggcaacaagagtgaaactccgtctcaaaaataaaaagaagaagaagaagaagtcggaggcagacacgtgaaatcctgtaaaattctgactaactctataaaagtcatctcataaatgcacccacccttcccttatttcagggtgctgcctctgggcagctccccgggttcatcagggttgtctttctccccgctttccaggctcaagccaaggccctctctcccctcaggattctcaacagccttcccgtttctcttcttctacccagaacatttctaacctcttctatgtcttctgcagaagggaagcatcttgagccataaacagggcagaagagggttaggcaggaagaaaggggagctggtaccccataaacgtatatgattattatgtacctacagtaattcattaagaaataaagaataaaaaaagattaggaggccgaggtgggaggatcactcgaggtcaggagttcaacaccagcctggccaacacggcaaaaccccatctctactaaaaaataaataaataaaaaattaaccgggcatggtggtgcacacctgtaatcccagctaatcgggaggctgaggcacgagaatcacttgaacccaggaggcggaggttgcagtgagccgagattgcaccattgctctccagcctgggcaacagtacaagactccaacccccctacccccttccaaaaaaaaaagaaagagagaggagagctgaaaaaaatgatcaggagaaaatccacaagtttgtaagttatcctgacactcaagaactctttgaagagggtttaaaaataaaaataaaacactaagccaggcctgcctagcctaactaaagaaaagagttaaagaaaatttgaattttacaaaaatggatgaatacacctagattgattatctggatacaatgtcctggattcaactttgcttggttagtgctgagttccagtgatttaaagaatcagtcaaagggctgtgggtcagcagtgtggaaagtgaggtgtacaagacaatgtactaggtactgaaagaaaatagtagtgcttctgtttatatatatatttcttattttttgagacagagtctcactttctctcccatgctacagtgcagtggcacgatctcagctcactgcaacctccgcctcccagatttaagcgattctcctgcctcagcctcccgtgtagctgggtttacagacatgtgccaccaagcctggctaatttttttgtatttttagtagagatagcgtttcaccatgttggtcaagctggtcttgaactcctgacctcaggtgatctaccaacctcggcctcccaactgtttatatttttatatcttgcctctctagctttatttttgtgggttttttttttttttttgcacatgacatactaatacaatagtgtaaatacatcagtcataaatcaatatgtatattttgaaagtgaatgctccaaatttttttgctgatggagtgcaggaaaataaaaggtttaaaccttgctaggcgtatcacattaaaaacgaatgctatctacaggacaattttctgtaagtctttatgcctctcgtagccataacaattcatctgaaatagggattgagtaccccgaactatgggcaacagtctgttttgtgacactgctaaccagaagaaacctctcctaatccagctacttgggaggctgaggcaggagaatcgcctaaactctggaggcggaggttgcagtgagctgagatcatgccactgcacgccagcctggtgacagagcaagactctgtctcaaaaaaaaaaaaaagaaaaaagaaaagctttttgagatgagagtttgtgcagaactgccagatttcgcaactaaaaatagcaatattggggagatacttaagctcacaaatgatttgttgtttatctgaaattcaccagatgtaactggtgtcctgtattttatctgacaaccttagtttagagtcagttctggttttgaagtccagctagctgagtgattcagggcaaattccttaacttctctgagcctcactttctttgtactctttagttgtagtgaacattctttttacaaaagattcgaagcccttagctacttcctgcacatcgtagaaaacgttctcactaaatcgtaggtattatcacgatgatgaccctatccctttcaacaccgtttcaagtatttgtgtacaaatcttatctcccttactagaaaggaagatccacgtttgcacagatgtacatgtaatgggtgcataatctgcaaattttgcataaattcagcttctgcccaagcacttttagggagtctagttgactgtcaacttggctggccccctcttccaattctattccttttcctttcccttcccccattggaagaatggtgttttgttctgaagttatttcaagcaagctaagcccttgtggaaactgccttactcagcttttgtaggccaggggatcccacagcccgaataagatttattgttatattagattttaaaactcccctgtgtcattctttgaaactgcagatgaaaatgaatagcatttatgagaaccattgtaaagatttaatgacatttgcattcacgctgctgaaagtaaataattaccgcactgggtggctatttttctgctgaatttagacagtttaaaacaacttgccctatgtgagcttgacgttagtttgaatagccccatcagaactgtgagttgggtgcgatggaagctgaggtattatgaagcataataaggatttgggggaggggagcccaaagacagtgacagggcatggtagaagggacttgctggactgttcacctttccaggccaccccttgaaaggaagcagatgtgggcaaaaaagagcaactccatttttcacacagtcagagccagcccaactgcagatggcctgtacatcgcagcaccaagcacatccctggtctaaagtgtcagttcttttttttttttttaattaaactttaagttctagggtacatgtgcacaacgtgcatgtttgtgacatatgtatacatgtgccatgttgctgtgctgcacccattaactcgtcattctcagcaaactatcgcaaggacgtgtcagttctttgtcctgccaccccttgctatcaaaagggaagaggaagatgagcataatggctcacgcatgtaatcccagcaccttgggaggccgagggggaaggattgcttgaggccaggacttcaagaccagcttagacaacatagtgaaaccttgtctctacaaaaaacaaacaaaattatccagacattgtggtgtacacctgcagtcccagcttgtcaggaggctggggcaggaggatctctcaagccctgaagatcgaggctacagtgagtcaggatcatgccatggcactccagcctgggcaacagagtgaaccctgtctcaaaaagaaaaaaaaaaaaagaggaggaagagtagagcgagaagaaaggccatctgaatctatttttttttaaaatcctcagccttagcttcccccatgtcaattccaccatcgctaaggatctcaaggggctgtatcctcttctcatgtgtcctggggactctggcagatatcacctctatgtaggctgcaggggagccaaaaccaagggattgtgcagccagtcctgtattcccagcacacagacctgagctgtgaactgatgagctgggttgaactttcaggcttgtggaaaatcactctcttccacatcttgatcagaaatcacttcccatgtgcctgactgatggagggattttccttcgtacccacaagggtcccacgttggaaatttaaaggcagatagctgcggtcagctgaaaagatagagtgcatgggtagatatgccaggaacattcctccaaggtggccagaaaaaggtccagagggctgggtttgataagcccagtagtcacccagttggctccagtgggaggaaatgagtcatgcagacgcaactgctgtgggtctctggagaacagctcctgcctgcttcattgacccctgctgtggctccctgcagttcataagacaacagcttccatcctgagccttgagtgacaccccttgctgctggcttgtgacaccctgggaagcctctgtgcctgaaccacccgactgtggttccaccttctggttctaccagcccacttatgttggatttcccatcctttcacaagctgttcgagttatactcagagagttatgatcccgacttttttgttcaaagaacacatggtcagagtccaagggctgttctggtgccttctgtgggaggcatcctggagaatgcaatgactcttggtgcaatgatgtctttccattttcttatccctcaaatgaagccttggatgaggtgatgcttgaatttcttcccaactctcagattctgtgagcctgagctggaatgatagatatgaacatactgtaccacgcaagagggcatggaaatttcaggtagcactactgtagttactattagttactattactatcatattttcctctgacttgtctcacaaacgaaggcacagcacaatactgatttctctcagtttacagttcccgcaaactgatcaatttttttaaatgacagtctgcccaaagaactcatcagtcttgcatctttggtaaatagctttcactcatttaataaatattcattgttatgctctgtgctagaccctgtgattataactaataataatagtcataaggcttttctttgaggtgtttataatctgactgaaaagacagtcattgaataaataataaaaaaatgatgagtgtccccaagaatgtcaagatgctatggaaatgaataattggggcacccagcctggttttcatggttaggaaaagcttccggccagaagtgacttccaggctaatagtataagctaacatttattgagcatttattatgggtgggtgggcatgttgtgtgcattatttcagttaatgtttgaaagaacaacatcagatagattctattattgtttctagtttatagacaaaagaaatcaaggcatacgaagtaaaaacatccccaaggctcacaactagttggagataacctctgaatatgagtacaggtagctgcacaccaggttctgtattgactgtggagtagaagagaagttggatgagtctggagataaagactgagtcagactctgcagtacctgatgtactgtgcaaaaagcaccctggaagaaagtgtcaactggttgtgtaaacttgggagggcatttattggttgaccctctgctccctaagatagtagtgtgttggtgaaagaaaaaacaagctactttctaattcaaaaaagagggagacaaaatggcctatatccagccagaggtataagggtttgttagaattaaaatttctttaaagaaaaattttctcagaactgagatggattgtgtaatcaaattttctaataagccttaagttataaaactctgtaatgattttaatgacgttctaactagtatctaccagttggtagtacctaccagttgggaactgcttttaaaaattcaacaaatttagtttaaagatccagttggcttttattagcaattcatgaattgggcagcatcccatctaaggatttagaaaggtgctgccatgacttgaccaagggaggtgagtttttgtgttactgtgaaatatttatttggtattcaaacccatttcccagcatagaactcttaaaaaatctttagaatttccaaagtggtctttttgtatgctaacaagttgattcatggctggtagcttcagattggaggcggtcaccagaaagatcaaggcaggattagagggttgggactttcagccccaccccctagcctctggggatgggagaggggctgagggttaaagtgatcatcagtgaccagtgttttaatcaatcatgccatataatgaagccttcataaaaactcaaaaggttagggcttgagcaacttctggatagctgaacccatggaggttcctgaagagtggcatgcctgtgtaagggatgggagatccatgccccttaccacgtgccttgccctgcgcatctcttcctatgtataggttgtaataccctttgtaataaaccagcgaacgtgtttccctgaattctgtgaactgttccagcaaattaatcaaacccaaggaggggatcatgggaaccctaacttcaagctgatctgtcagaaattctggaggcccagacataaaactggtgtcttgtgacgagggtcagggggtgcagtcttgtcagactgagccctcaagctgtgggatctgacgctatctccaggtagatagtatcagaatttaattggaggacacccagctgatgtccaccgcagagctgattgtttacttggtgatggagagaaagaggagaaacttcccaccacacacacgtttggtcacagaaatcttctgtatagattattattgttatggtaagagcagaaaaaaacctaatttgtgttttttcccctcagagttttataggcagaaaaagatggaagaaagcagacacaaggaacaaaaagcagactggtcattacaaaattactttccttatagggttaaaacagaggggacttccttatgccggctcaggtaacctgcaccccttcctagtggttgctgtgaatctcctggtttttttggaaaactagcccattttaaagtttagtttaattatgtggcacttagcatgaatgactccattttggtttggtctgttctgttgggacctagtgcaggagctcagtccaaaacaatggcctcctatgaagtttatttaatacaatggaagtaaatgttcactgctttacttcaagctaaaatcacaaaggcattgattctagcaagttcttgtttttaattcctggcatttcatgtttggaccaaataattctagcaagttcttgtttttaattcctggaatttcatgtttagaccaaataatgaagcaatactagaatgctgagtgggaagaattttattcctaacgtttttaaagcataattcagaaaggttaatcttgaacattttttgctaggggggacctcatcacattcagaagattaatctgctgagcagcgtttagattatctcggtattattagaatgtttctccctttacttgaaaagaagccattggaatgtccctaacacaaagaaatgataaacgcttgaggcaacgactaccccagtgaccctcatttgatcattacacatcgtatgcttgtatcaaaatatcgcatttaccccataaataggtataactgttgtgtaaataacagttaaaaatagataattaacatagttaataattaaaaatattttttaagaaacgaatcaaaaacggagaaaaaagaagccatttaagcattctcatgtctaatattactctatttaggtacacactaaaggtgtctttaattattaggaattacatgctgttaaagcttaattaactagaactcaggtacttggagttctcgtttaattgaatttctttttgttgttgttgctttttctttttttttgagacagagtctcacttcgtcactcaggctggagagcagtagcacgatcttggctccctgcgacctctgcctcccaggttcaagtgattctccagcctcagtctccggagtagctgggattacaggtgtgcaccaccacgcctggctaattttgtatttttagtagagatacggtttcaccatgttggtcaggctggtctcgaactcctgacctcaagtgatccacccacttcggcctcccaaagtgctggaattacaggtctgagccactgtgcccggccttgaatttcttttttgtgctgtatctaaggcttcaaggaaattgccggattataagatgctaaaaataaaaaaacaactcttattttaagactaaggaatccctttctgactatgcaccttcaggccaggattctgtgtcctccagttctgacgcactaccacacttctagggaagaaggacatgaacttggaaaccaggtggacctgggtaaaagtctttactatactcgctattgatctccagacatgctattaatatttaatttcttgatagctacattcattcatctgcccaacagggatggtaatacctgtctcaccacgatgtagtgagaatcagatcgcggggttgtgtaaggaaaacagagggccagtccgtgataggcgctaaggaaatcgaaagcatttaaaaatctagatttagcctgagccaccacaattatcacaaatatccaaagaactgtggcattacatttgctattctgtactacctctggcagaaaattattccttcatattttcaaaagatgattttaacaatgacagttaaaattgaaatattttggttagctaataaattggttaactcttggtaagctacttttaaaatcagctaaccagtgtgcccaatttagaaaatacccaggttaataaaagattgattgtcctgtattcagaaactacagtgttttctctacagagaacaggtgcgtcttacagactcaatggaactctcaactctgattttagcaaatttgaaataacagttagaaactagtgctgtttttctctacctttctacactaattaaatctgtattcttcaagtccaactgtctcacacatgacttctaattaatttcttctttttttaattaacaaatacctatcggcaccttcacttttggatagacattttttcttgactagtttttaatggccctgagttttcttttcttttgcatttgaggtaaaactgatcaagtcagctagatatgatttctgcaaaaagattgatatttcatacgtgagtgatcacatgtctgtagtaacatcttacatgaaatgcatgctaatctacctgattttggtcaatatggattttgatgtaatgtagcgtttcccaaaaatgtggactttaagtgataacacaacttctattatttttattttagaagttatgcatctactttaaagcatattagtatgtgtcttttacttatagaaaataatactggttttccctttattaataataaatctaaagattcttttttaaatgatttaagtagaaaaagcattaggaattgaatggttgttattcatatatgacaaaaattgtgtagatggtctgtcgtggagttaactggggaaacagtggtctcttgctgttcttaactgcatgacttgaacaagtctctactcttctgagtttcagtttcctcatctgcaaaatggggtttggacttgatgatcaccccatcaactgtaagcattctaaggtaacagacagcattttattcatctttctatcccaactgcaaaacacactgagaggaacaccagtctgcctcaatgtttgactgccaggattccataaattaactgagaccccgccgcttctgctattcaaacatccctctaattctatgtccttagttagcatttttgttcagttgcttattggtaggaatacattgtgtagccatcagcttgaatatttaaaccattgattgagtttacttgtgttctggatgaactaggtgccataaaggaagtaagagaagtctagaaagtgaagaatggcctcaaagagttcacagtttcattgggaaggcgcttggaggacaaagtagccagacagataatcagtacaattgggtgtaataaattttacccagatggggagggaaagttgttgggaagtttatgtagaatataggacatgaccttgaaggaagatgagctaaaataaggataagaagaagaaggagaacattctaagctgggttcatcatgtgtgtaaagtctgggaagtgattttttttttttttttagacggagtctcactctgtcgcccaggctggagtagagtggcacaatcttggctcattgcaacctccgcctcctggggtcaagcgattctcctgcctcagacttctgagtagctgggattacaggcacaccccaccacacctggctaatttttgtatttttagagagacagggtttcaccacattggtcagagtggtcttgaactcctgacctcttgatccgcccaccttggcctcccaaagtgctgggattacaggcgtgagcctccgcacctggccgggaagtgatttttttttttaaatgcatgatttaacaagttcaccagcaaacaaacaagatagtaatacctgtccgctcctgattcaagcacagtatttgcaatcgacatacttgtgggttgagtcattttgttaataatagcgtgttttgttttgtcttgtcgccagtgattaaatttttcactatatccttttttaatttcccaaaatatttttatttttattctctaattataaggatcttgaccaactgaatgacttcatcttttttgtttgtttgttttctcaatgtggtgtggctgtgtgtgcatgtgcatgagtgtttgtgcttattttcaaggagtcaactacgattttatatatttctttttaaactgtctgtgtagttataggaaaatgggaaggggtgaggataaatgaggcacaagcagatgctgctggtggaggctggcacctggctgatgcccatggagcatgccaaggctgtgaaggaaaccctggctaatgaatgtgccccactgtgttttgtggctggctgaaagaagtcaaagggccagtcagagaaggtaggagccaggagccttcaacaagggggctgttgttaccctgccaaagaagatgcctagataaccagggatgggcaccgtcaaagccacttgccagttttaaagctcgtgcccttgcatgactggttgcttccatgtctcatctttcagttccttctttcccccttcagctaactttataattgagggaatcataaagaagaattccatcctgtcagtggaaaacaggtataacagtggaagaattattgattagactttggcatggaggcatatttcacactgccaagatctattgacatttgttgctgttgttgttgttgtttgagatggggtctcactctgttgcccaggctggagtgcagtggtgcaatcatggctcactgtagccttgaactcctgggctcaagcaatcctcctgtctcagcctcctgagtagctgggactacaggtgtgtgccatcacatctggctagctttttgttttttgaagagttgggatcttgctatgttgcccagactgagacattaatatgttagagtggagctatatataagatctatagacctctgtggttacagatataaggaaatcagtaaacctaaaagtaaactgtagatacctatatattggtaaataggaggtattgatagcaaaatctcttcacaaatattcctaaaactgtttcttggaaactcatttcatttttaaagttttttttctctttttcaattttcctctagtcacctgaatccacataatccttaaattccaaaacttaaaaatgtattcatttccttcagctgatgttattcacaggtgaggaagaagagaaactgcatctcagcaaaaacctggattttcagagttagggcccttcctacataatacgacataaaagctgtcatttgaaaggtcagtgacatttaagggtggacttttgtcaaaagcacttatttcaagcccagatttgacagcagcccgtgcaggcttgctcatccattgatttccaagtcctgccccattgctggggatgcagctctctgcacagagcaaagccagaagttccagtggttatagaagacagagcctggtaggtgccctggagaggaggctgggcagatagagctgaagggcaccctggcaggttgggaaaaaagcaaatgatccaagagaaaggccatgaactttctgtgaattgtttatttcctgtctcctttatctttacaatttattttctaacctttcttctttttcttgtgggaatgattaaaggtctcaactcagtgctttacagacgtagaaattttttaaatttcttgactaactgatagcaaacttttgttctcataatctccctgtctaggcacaggggtaggagaaggagggatctgatgttacccaataaagtactttggtcccacctgatactggcttaaatcttagacttttctaaaagtttagattgctggggctagtttcttgttctgcaccagctgctactggtgctgctggaaatagtgtgtttcagagcttggtgtaccctgctttccttgtgcttctcatgagctctcctttttttcctttgagttccatcatccgcagaagtagcaacagagatggaggctagagggacatcttcctacgcaggtaaagggggtctaaggaattgagaagcttgggtgtggtccctcctctgctggcccctgttgtggcaccatttcctggtttgattcctggcactgtgaagcagactcacccacaactgggtgttatttggatgagagactttccgatgacttagattctggtgattctgcttttcatgtctctgctaaagtggagatttctgtgtggatggcataaggaatttccatgggcagcgttcagcctcaatacagctaaccagcccaaaagatcactgggggacagtcaatctttcctgtggctcttgccagccatatatgctatatctcttcaggttgggtagctctgctttgaagagtgaacgcgagggccagctatgggtgcccatccttcaattaacctcacctgggtcacagaaaccagctgaatatttgccttgatttccaaagccatggagaacaatgacaacatcctcacttcctctttccaaggtgctccacgtgatggctccctctcaccctacaggcctcggtactgatgagccactaaccatcaaaaatagctagataaggagctggcactgttctctaatttccagaaacatctccaaacttcaagaaacttttgtacaatgtgcttaatcacccaatttagggaaaaggaagagatacaggtagaatttaagttgggcctagctggtagggtagacaacacttttttaaaaaaattatcatacagtaaaattgacttgtgtctgtgtgtgtgtatgtacagttctatgaattttaacacacatataatataaatgtatataaattatatataaattttatatacttatattgtatatgctattatatattatatattacaatgtaatatatcatataattttacattatagattatattataaatatatttatataaatttgtacaactatcaccaaaatcaggaaacagaactgttatatcacccaaaacaactcattaatgctatccctttatacttatactttctccccacccataatccctggaaaccattgatctgttcctcatcgctgtagtttagtgctttcaagaatatcaaaacaaacgaaaccacaaagtacgtaacccactgagacttgtttctttcactcagcaaatctcaatgattttgagattcaaccaagttatttcatgtatcaacagtttgttcctttctgctactgaatattccacttacaggtgacccttagtttgtttactcattcatcctttgaaagacatgttagttgttttcaagttttggtgattatgaatagaggggctgtaagtggtcctgtagaggtttttgtgtgaatagaagttctcagttctctagggaaaataggagtgggatagctgggtcatatgatgagcgtatgtttaacttttataaaaagctgccaaactgttttctagagtggccctgtcattttgcacgcccaccagcaatgtatgcgagagctagtttctccacatccttgccagtatttgatattttctttttcttttttgccattctaataaatgtgtagtggtatctcatcatggttttggaatttatttcactaataggtgtccttataacctatttggggtcttggaggccctcttctttgggggcataactctttagttgctagatgaagcaaatgtttagcagggtcccagagaaggggccaagataggaggagaggtggggtaaggtggctaaggatggtaactatttacaaccagtatgaaatatttcaatatttaacaactggtatagccaaactagtagagatcattgaatgtaagtcctggatcttgcaaagaacacagaaggcgtgaccagagtggtgggcagaggttttcgtgtcatagaaaactgaagggttaattgtgtttcatgctgctgagatgaggccatgtggagaccttgacaagaggtcaagagaaacttccatggaaagatgggggtgaaaccaaattctagtaggctgaagagcagtatgtgtataccactcttggagtgaacgagagtggttatgaacaagagtagagaaatttcttgttcaaatttgattatgaacaagagtagagaaatgaggcagcgggtggaagaatgcataaagagatagtcaaacatgttcatatgccagtgagagcagtacagggagtatgtgctgttgatgcaggattgaggggttaaccaaggggaaccagttttaagaaggaaagagatgaagtagcatcaagagctcatcaaaagctagctagaggcaaaccggcgtataggtttggtgatagcaagatgaaagttcatacccttatcagacagcttctattttcttaataaaagtgtaagctgagctcatcacccacagcttgggagattagagggaatttttagagcagaacaagcttctacctaacctcttgtgaattcttacacagtgaatccctttattgtattctttttatctctatttctttttacttttgtctttgttcacttattttgaattcctgccactaaggaaggggtcagcaagggatatttggatatatttgcaccagacatgtaatcagggttcacttagcttcccaatgtggaacctagaaaaccagcgacagagtttggaatagttgatgaaggagccaaactgataatggaaaatgtgcacagacataatatgtagtttggagccttaatggaatgtttgctgcctgttgaaatttggaaatgatagcaactgctttgctaatatgatttcaacttagacatatcttcatttgcccatgcatttttcatgctaattagattgtgtacatggaatttgtccatgctttccatcaggagccttcttttttctttataattgtacaacgtgtcaaaactctgacttctcttctactgaaaggaacagttccaagaaatttttttaaattaaatccacatattcagacccagtttctgactggctcgatcaattatgttataggagggtcagttttatttgcaaagctgcaaccattaactgcctggaggccatgacaggtttcttttgtggactattttttaagttatagattctacattgaaataatatattttgtctgcctgtatttgaaaacgatcaaagaaaaggaagttatcccacgaagacgttactgcaagtgatcgcatttcaatgagattaaaagtcaaagaatagcaacaaggggcagagtatttaacactaaggagaagaaaagaagtcagactgacataaagatttttcaagataatagagttatgttacagcagaatgtgtctttaaggaggtgtgtagcagcatttttaataagagaacagataacctgggaaagtagtgtgttctcctgacatatgcatcagcaaggctgagtgttgaattgcattgatttctgtgtctacctttggtgaacagctttccaatcaagtttaatgtaatctgaatacaggaaaaggaatcactgccaagatgaaatctctgtcgccacaggtcacagcaggaggtgtgaattcagtgaggtttgacatttcagtgcacttgtcttaattgtgtaactttgctttgtcaacagtctgtatcatgaacaccaactatacttaccctttctaaaccttttgcctattcttggtatcttgaccttaaaaaccatagcttagtcctttctcccaaggattaatgatgcagaccagtgaaaaaaaagtctacaaatcggccgggcacggtggctcacgcctgtaatcccagcactttgggaggccgaggcgggtgaatcacctgaggtcaggagttcgagaccagcctggctaacctggtgaaatgccatctctactaaaaatacacaattagctgagcgtcgtggcgggcgcctgtaaccccagctacgtgggaggctgaggcaggacaatcacttgaacctgggaggtggagactgcagtgagccgagactctgccattgcactccagcctgggcaaaaagagcaaaactctgtccaaaaaaaaagagtctataaatcatctaggacgtaaacatgtcattagttttgtatgaactgcctcttgggtaaccatcctaaattaagctaggcaagactattctatggcaacatagcaacatctggctctcagtggattaatgcaacaaaggcttatttcttgctcatgcaactcaagtaaagagaagagagatcaagtagaggaatcagagcttttcactgccttggcccagaagtgacaaatgcatctcacattgtctaggagaagtcacagtgctttgtctacctgtacaggggtgaacaggtagtcttccctgtgcccaggtgagcactagaagtttctatcacaaattttctttctgctggtaataaataataacatatatgtctatagtgtataatgtatatgatattctaattttctaattgacttagtttaaaggttctccaagcctagaatttcaggtctatcaggatttaatattgtttgtgctatcagatgttatcaagcgataaatttgttattatgattctgttttgagaatagtttctttaatctcagttttacaaaatagttttacctcacaggtattattaatatgaagtttaccaaaaatatgaattccttggaataaatctggcagatatccaaaggtagattctttactgcattttcagcatataaaaaattacggcagatgtggggaagaaaatggagatggtaaaaataagtaaataagttgaatccatgacaagatgattatagagctctgggaatatcattttctccttcccttcctcctttcctttcttttttctttccctcaacaaacattattcagtctctgacatatgctacaagttcttccaggcaccaaaaagatgatcataaaccaggtagccattgtccctgcattagtttgggtaacacgggatactctcacagataaactcctgaatctcaagggcttaacagaatggcagtttcctttaaattcctgtacagtccaaaatgtgtgtttctgagctgtgggaggatgttttcaatcagcaattcaggggctagcctccctcacttacatgactccatcaattcaacatgtagcttccaaagcactggatggcaacaagcccgcggcaggagaaaggccctagaggatcccatgaaggggagtttcagggacctggtctagcagtgctgtacatcaggcccaagtaccagtacaacttacagtcagaggagaagacacttaaaggacaggaagaagtaagctcaaggagtcctcttttggcttaactaaccactaaggtgaaagccaaccaagtaagcagtcttgtaactccaagactgcaaccttccttaggtgaacaaaaatcaaaatttcattcattcatttgtacaaataattattgagtgccttctcttccgggcacttttctaggtatacagaatactgcagtgaacaaaacagaaaaaaatccttccctcacagatctagtgataaagtttaagataccattagcatgtcacttttttttttttcttgagacgaagtctcactgcaattctcctgcctcagcctcctgagtagctgggactacaggcgcccaccaccacccacctagctaatttttgtatttttagtagagacggggtttcctcatgttggtctcgaactcctggcctcaagtgatccggctgccttggcctccaaaagtgctgggattacaggtgtgagccaccacacccggcctgtgttccctcttgattaggcttcagatgtttttccaagttcatcttaagtctctttgtttccttacttcatctcctcatttgataagaaatgaagctttctctaaatcactctgtcccagcattctctcctgtgagatttcattttattctttttctctttcaagaagagaggagtgggtgtgtgcagcagggggcaggggacgcagtgcggagggatgattctgtcctcagcacttgttccagagccaccacacatccccatttgttcccaccacctgcctttaagacgttactccagtcatcccctgtgcgccatagacccactttcaccttcctaagatgactttaacacttgggatttctgtctgattgaatttatagtgaaccactgtggtgaaagcctgcccagtaagtcaccttgtcactccaagactacaacctcctagccactcaccctcctagggaatttccctaaatttacctgtgtggccaaagccctggctccaggctgctcatctcctgcctgaccttccacagtgtgaaggctcgaggtggggaatttgtcattgtcagtaggaagtgacacaagcaggccctctacaagtaagcctgggcagcttggctggacttcctctacctactcacattcaaagctgcacccaagcacctgtccctccccagtgtgcctgattttcaagtcttgggggcacccaatggacccacccacccacagcttagggggctcaagtcctgaccttcagccgtcaccaagattggcagcaactagactccttccccctttgtgtagacaatctgacccattctgatattaccgaactcctttcccaacttggacttccgaattagctgaattaacaatgaagcctccaccccattcctcaagatctgagtttaggtaataaagcacagctagagaaactacaagaaacagtttccagactaaaccaattctcagctcttgacactttgctttgctcattttctgtatttcttttctttttctttttctttttttttttttttgagacagagtctcgctctgtcaccaggctggagtgcagtggtgcgatctcggctcactgcaacctctgcctcctgggttcaagtgattctcctgcctcagcctcctgagtagctgggactacaggcgcatgtcaccacacctggctaatgtttgtatttttagtagagatgaggtttcactgtgttagtcagaatgatctcaatctcctgaccttgggatccgcccaccccggcctcccaaagtgctgggattacaggcgtgagccaccgtgcccggccacttttctgtatttctttaatgaactttctgactttctcaccacagtggcttttctggaccatccttgctctcttccagcctccacctttgcttccatccaatcttgctcctccctgcagaccttgccatggaaagcctgaaattgggcaaattgtggaccctggcacaaatgcccccttcctcattctccatcactttgatctaattttatttctacatctgtcctctctttttcttgtagtatcagtggaagatattttcctattccttcctggagttaattaatctacctgtgctctgaatttcttcacgcctgagctaagagatcttactcctgtagactgtaatttttcattagttctttgtgtttttctccctgaaacagatgtgtgagctcttgtactatgctaggtacggtggatacaatgatgaaccaaatgtaacccctgccagcagtctagtaggggaagatggtaacatgctaatcccccaactttgttataaatcagcatgacacaatgacaaatcgttctgcaggtagttactggaaggagcaattattctgattggggatttttatttcctctgctgcctcagagccaatttccacactccaggagcagaaagaatagaaaggaagaaaattcatgcaaacacactcattaaaacattcacccattcagaaaatatttattgagtgcctagtatgtgccagcactatgtggggtgatggagacaccctaagaaactgcattcatggagtttatagataactaaagatgacaagttttgataacacgaataagtataagctaaaaaggggcaacactgagtcatatgagagtatgtaacagagagtgtagtctgatcccagaaagcaggaaagccttcttaggacctggataatggaactgaaactgagaactgaaggacgagcgctggttatcgaggcaaagatgggaaggaatgagcatcccccgattgggaccagagggaggagggtctcttggaccagcttaagaagctgtgtgtttattctaagagccatggagatgctgaaggtctttatgcagaggtgagacatgatcagatgtgcaccctagctgcagtgtggagaggtttggatagactctgaggatgttggaagagcactagaattggaatctggagtcatatgtcttaacatcaaatcctatgagcctacagatcttaagcaaactctctttcctttctgaggctctgtttctgcctcaggacaccatgacagttgggagagaatgtgagtgactagctcctggctcacgggaggttttcagcccacttgtttaattccttatctttttctgtatttttttttatactttaagatttagggtacatatgcacaatgtgcaggttagttacatatgtatacatgtgccatgctggtgtgctgcacccattaactcgtcaattagcattaggtatatctcctaatgctatccctcccccttcccaccaccccacaacagtccccagagtgtgatgttccccttcctgtgtccatgtgttctcattgttcacttcccacctatgagtgagaatatgcggtgtttggttttttgttcttgcgatagtttactgagaatgatgatttccaatttcatccatgtccctacaaaggatgtgaactcatcattttttatggctgcatagtattccatggtgtatatgtgccacattttcttaatccagtctatcattgttgggcatttgggttggttccaagtctttgttattgtgaatagtgctgcaataaacatacgtgtgcatgtgtctttatagcagcatgatttttctgtattttctaagcctcttagccattatatccttgacaggcggggatatgggcatgggcgtagattgtgaagcccactgcatttttgtggctagttctttttctgctcagaaaggacattctggcacacttccaaggcccagaaatgacagagtcattttaattagaacactttcttttttctaatttgcaaattgcagtcctcaaagactaacttagcagagctgacatggcctccttgacctacattataagtaatgagctcttgatctaagaattaatgcagtctccatcacgagttgattggcatgtttgaacaaaagtgttatgttttcaaagccctggcttatttgagactttcaactttctgttgaaaagtggttggaactaggaattttaattgctccattccttcccttgtcatgattggtttttattaatgggtttgtcagttaacaggttacactgtaagtggcagggatgggattccagtcagggaatctggcttcagactcgaatttgccatgctgctctgtgtctcactaatcaatgcaggctcaggaggccgaggagagaaaataacctatgtttttaccttttcattagaggagaaaatagagacatcttcactattgtcttttttttttttttttttttttttttgagacagggtcttagtctgtcacccaggttagactgcagtggagcaatcgtggctcacagcagcctcaaactcctgggctcaagtgatcctcctgccttggcctcccaagtagcttggactacaggtttgcaccactatgtctggctaattttttaaaaattttgcagaggtagggtcttgctatgttgtctgggctggtcctgaacttctggcctcaagcatttctcctgccgtggcctcccagagcactgagattgcaggtgtgggccactgtgcctggcacatcatcctttctcatagattgtaaaggcacatgaaggtcttagaagcacagggagctcattcaaacatatggcttagatttaagggatttctgacctcttccttgtgtgtaggactacgacgatgggagatagtctctccgctccaccttgcaagatatcacctccttttggagcctattatgggatgacttgtgtcctcctcaaaattcgcgtattaaattcctaacactcagtacctccaaatgtgactgtatttggcgatagggcctttaaggaggtaattaaggtaaaatgaggtcattaggtaaaattagatagggatttaaagaggtaattaaggcaaaatgaggtcatattggaccctaatccagcatgactggtgttcttataaagagattaggacacaggcaacacagagactgaggggtgaccctgtgaggatagagcaagaaggcagcaagcaaaggagagaggctttagaagaaaccaaacctgccaatgccttgatcttggccttctagtctccagagctgtgagaaaatcaacttctgttgcttaagtcacccagtctgtggtgttttgttatggcagccctagcaaacaaatacagaacctaaggagctctaccaaatccatgtaaaatgaggaagcttcattaagattctttgcttccctgctcatatagaatccattggattctaacagtgacagttctattttgtgaatgaggctgattactgcttcacaggcaaagtgtatctctacggctgtcaactcagcatttcacagttctcatgtttattggccatcttgataacttggagtctccatctcccttacttctttctcatttcttttccacggatatacaagctagcactttggcagttaaactgctttgagtacataaaggtattaattcagcagctgagccccctttcattattttatccatatatttttgcaagcttaatggtttttaccatttaccatgctcaaggctgtaaaccatttctccaggaatctgactttcaaaggtgcaggctttaaatgagttttgcccttgtaaaaggtcccataaaaaacatctttaggtgctcttaaccaccgagttgatatgtcggccaggactctgcagcctgtgggagagggtggggccacctctctttaaagagccaaagaggttagttccattgtcctaccaggctccctggcattcagatttatttcagccccagagggcagccgtgaagcttggcctcaccctggctgccaactgtggcagaggcttcaggaggatgacttgaaaactgtctgccctggctctttgaagtctttggatgtgaacatactccttgtttctaggtttgggcgagccaggaatgccgacaagttggtcattggagttgctgaagaggcaaaggtagaaggtgaattttcatgctgcttcattaaaaaaaaaagaaatctagccaggagacactcaatagccaaacctagctgtgagtaggcatcatctgacagcaggggcttccgactaagaggcccacctggccactgcaacaggctcccgtgcagtgtgagatgctagcttctgcctggaggacagacaccttgtcgtccttgttctaatgcacacccattcttagggaggagagggataggtgtctgctttgttcattgacatcattcaacacatccctactgagtgcccgtgttgtgccaggtatgacataaggtgtggcagaacagcaattaacagagaaacctggtccctgaccctggggcttgatggtgtagttgtaaaggaagcaaagattgtgtttccctcccccaaaactcaaactctatagctccctcttctttgtcctttcctccattcatttaccccctccacattcttacctcccagaggtttgcatcctagaaagaaggctgcaggaagagagtgacatttatcctagggcatgaatccttaatggtggaattttatcatctgactagaggatattttataataaatgagcatcttgtggcctctccaaggcaaggattctgaatcctttacttgcggtgaaatctatacaatgcattactgtaccctggaggccacagggaggccacatgaaggctgtcccagggcacagagaactgcagagttagagagggacctccaggcttgcaaatcaggagtgcgttttatcatcagcaaatcaacagctgagtggcactgaatttctctgccgaggctcttaagcacctagtttagtttctgcttcctgcaaagagatttatgtccctgtgtagcagaggaataagaggcctgctggcaacgagccccggagagggagtgggatatgcagaggatacactgataaatgtaattgctggaagctgttggtcccagggctgccagccctaagatttaacccctaactctccaggtagtatatggtacaacccactcttgatgagagacaagtgttcacctgagatgcaaacttgagaattttgctgctgtcactacccagtttaaggcctttttttcactgcaggacaaactatttcacttgccaaggcttgagtgatgtaagcttcattattaactactgttcagcagtgtcgacagtatttctttgaaatttcttttgtcagctttaacaaaacctcatcagatcttactgaaaggattggcatctggagctttatttggtaatccaacattgcatcaactcagaagacaaaggagcttgagcttgtcttggaaactcaaggcaaagttatacttgggcatttcaaaaggcagaaagaaatggtaaggaatacagtgccaagattgagtaagaataggcatggccctttgttgagcctgacctcagccagatgcatgatgctgggaacttaactcatttgttgaatgaataagtgatggcccaataaaggaaatcggttgctgctaaaatgatgaaaaggtcagaagtataagatctagttaccggccaggcacggtggctcagcctgtaatcccaacactttgggaggctgaggcgggcagatcacgaggtcaggagttcgagactatcctggccaatatggtgaaaccccgtctctactaaaaatacaaaaattacccaggtgtggtggcacgtgcctgtagtcccagctactctggaggctgaggcagaagaatcgcttgaacctgggaggtagaggttgcagtgagccgagatcaggccacagcactctggcctgggcaacagagtgagactccatctcaaaacaccaccaacaacaaaagatctagttacttcacccttgttctatacaatgttttcttgtttcttattgtgtaatccctataagagtttgcttccccaaacttaacttgaaattaatttcaaccatccttggtaatcatcttttaggggcagaggataagggatgatggttatagccagaaaggagatttaaaagaaatgacttgagaatctagtgatgattagacgtaatgcaagccctgaattcaactgggaataaaaacacttacctgacaggttattgtgaggatttaatgagaatgtttataaagcatctagtggaatgctaggacctaggaggtgacccacaaatgttaacagcatcttctccaccctcccaacactagctggtttttggctaaatcagatggctggattcttttccttccttccatttctaggatttccttcccctttaaatggagaaggtgttcctgaagtaagggataattacttactatcattctgtaaagagatctaatctttgccagagcaaagaatttcctaatcacttgggtaaacttctgtagaatcggtcctagaaaccagctactgagcactgccgctttcaagagatctgtgctgttgcttagaaatgcttattgtttgtccaggaaagaagcttggctgtgttcaagggcggctggctactgtcagtctcacctcccttaacacttttgttaaattcaaaatgagagatatatgagagggatatacaggtcccttgtcaactttttctattgtcttgtgaatctcttggtttcatatcatattctccttaaaattttccctttactgactgtaagaaataaagtccaaacattcaaagctttcacaattcggatattacttttttacttttctttttctttttctttctttctgggtttttgtttttttgtttttgatggagtcttgctccgtcaccctggctgaagtgcaatggcatgattttggttcactgcaacctctgcctccggggttcaagcaattctcctgccttagcctcccaagtagctgggactactggtgtgcaccaccacactcagctaatttttgtatttttagtatagacagggtttcacgatgttggactggctggtcttgaactcctgacctcaggtgatccatccaccttggcctcccaaagtgctgggattacaggcatgatccgccatgcccagcctggacattacttttcttaaaagtctcatctccatcccaccttggaacatgcttaagccttcacatttttctatacaatctttcccgtctctccaccaaactcctattcatccttgaagaatctcttctgtaaggctttatggtaccactgagcaaagttctcatagcacttccatagttctttcaatctcacagtacatttgtgttttaattatatttgtatgtcgttgttctcattagacagcaaactcctagaaacaattacctggcgttaaaagtcttagtgacaagattaaggactatggaatgacttacagtgaaaaagaacaaaagatactttacattcatttaatatctgtagtagatgctttctaggatataattgatataatattatttaatctattcaacaatcatgtagggattaacacatttacagattagtcaatgggcttaaagatagagtgatttatttagactaattaaggaagagcctagaattgaatcctatctgacgctccaaagctcaggctcttgcattacaccaggctggctcaggaaagggcaattatataatcaaaggtacaggctggcattagtaaatagcgtggattgaggagaaaaagcagctaggagaccggagcagtaattcaatagtaaggcaatgagggcctaaataagattaataaatagagaacaatcaatgaaagtgataaatattgataagcaggagccaaatggaaaggtcctgaaaacgaaaagcagattcgtagagctcatcagtgtagcacagcatcttacttgcttctgactgtggctgaaccagagttgaggtgggtggctctgaggcctgtgcagtaggggcaggcagagcacagtcctgaggctggactcccagaggaaggtgctctgggccctggggctgggattgctgctcagcagcttgttgagcagaaaacaaagactcagatcctgcagaaaatatcagaaagcagttaaagcctgtcttagtctattttgtgctgctataacaaaataccacagactaggtaatttatgttgaacagaaaagtattgtctcaccattctggaggctgggaagtccaagaccaaaggactggcatctggtaagggccttcttgctgtgtcatctgtggcaaaaggggaaatggcaaaagaaggagcctactctcaaaagcccttttattaaggcattaagcccactcatgagtgtggagctcttagtgcttaaccacctcttaaaaaccccatctcccaataccattccatcggcaatttaacttcagcataagttttggatgggacaaacgctcaaaccatagaaatgcctattcaagatttcatacaatatgtggtcatgttatttcccccaacaactctaaacctaaaggtaacctgcaaaagcaatagattggaccccaatctactagtttctttcccagccagaatttgttaagttcaaggggatattgacaactgtacagaaactgcagcacatcagccctccaaaaacactaacagacgagagagttgtttgtgagctctgttcagctgagtatcatagtatgtatggaaaggtttttgaccttgaactaccactaaaactgttccaaaatctgtttatatggagtcattctgcatgtacaaatttttaccacagccattttggccaaatatcctatttgccagtctatcatatttggcaagatatggcctgatgctaaacatggaattgatctcttggttagtaggcttcaagtcttgggtctttacaggaattctactcttttctgttctgcccattttttataagcctcttctttctgtaaggtcaaagtagtttatggataagaaccagattattggggagaggaggtaggttgaattgaggaacatttctttttgtcagtacctccagcctattcgtattgttggccagctcactggtacaattaatctttttgattttataacgatggaagttgtgtttaactggagatgagagcaattaattttcttcttataaggttgtgctttctttttaggaagtacagttttttcataagtacttcaattaaaaaagggagagaattgaacttttggcagcaaactcaaacattataagtgaaattaagatgcccaagtctgtgctcaatagcattgtatgggtttgtgatatgccttcaagctcttcatgaattcagttattttgaattcagttgtatttcagcgaccaagacaaaagcatttttgtgaggtgctttttgtttatatcccaggattttatttagaaagaaaactgcacaaatttcactggtatccagacatggtcaactttattgaaaaacaaaacacaaaaaccctactttgctagtggaaaatgtaagttttttgatatttcaatcactaacgttcttctgttacatatcattttctttactttctatataatggacctagatttagtgtatctgtcactttggtttgaaacgtgtgcctgagtttgcttggagaacatgttggggacttatcctcatgtggaagccatcaccccacatttcactgagcctctggaagggaaacaattttgcagaatgtaattctagaagctgggtcacctgtgaaatcacactggcatttgatatccttaagaaaacaaaaaggagcctacagggacaaaatatcatatgtgcaatgtaggactccagacctttcccttcccttttattatgtaacgttttaaaagccacatgttcattcagctgtttctcatcagttttgttttgttcccatataaacacatacacacaaaataaaaacaattttaataaagataaattgttttttctcttaaagtttctttgatagtggaattcatgtaaaactctgaattatgaaaaagttaaaaaaaaatccaaaatagaattttttaaaaaatgcagttctgattgtgtctttcgtcttgtctccccttttcaaatatgttccttcattcttttaaccctctgtaaagccacataggaaaggcacagttttgaaataatattagcaattaaggtttctggtttatttttaacaaggataaataatgcgtcagaaaacttttgcagattatatcaaaacagaggaatgcttgttgttcagaacatgtctggacacatccctagtcttgtgtcatctatttgaaagctgcctgggcgtagtccaatgtgtttacctgatacatattgacttacagttattttagccgtctttgtggataacccaggtaagtgcaagagatgtagcatttccagtagttacagctttgaaaagtgacatagcacactggaaaacatttgcttgcactatttgcactgaattttacttaaacgaagcatggtcacttggatgtccatagaactttatagctttgtggttttcatacacattctctcacttaatcttcacaaagtgcatccctttaccttgagtctaaggcccaaggaattctgactacacatataactaaaatgagtatcgtacaacattccctatggcactcccatagataggatattagctcagccagctccaattaactttgttcttctctgagttaatgcatttcgcagtttgcctctggtttacaggaggtagtgggccataaaagtagatgaagaaggttctatataaaatgggatcaaggttgggtgtggtggcttacacctgcagtaccagcactttgggaggctgaggcaggaggattgcttgagcccaggagtcggagaccagcctgggcaacatagtgagaccatgtctctataaaaaacacatttaaaaattagctggatgtggtggcgtgcacctatagtcccagctctttgagaggctgaggcaagaggatcacttgagcctgggcgttcaaggctgcaatgtgctatgatcgtgtctctgcactccagcctgggtgacagagtgagaccctgtctcaaataaacaaataaaataaaaataaaatgggatcaagcttcgcagtgtgtagaatctcagagtaagagaccttggataacctgtggtccaagaacaactcatggacaacattcctgatttcttcccttttctaaagggatattacacctcatcagttagcttattcagtaagctcatcacttgcaccaatatattctggtccaagccactgtgatctctcacctggctgattgcagcagattctgaatcgtaagcagtcttcctgctgtcactgttgtcctgccccaacgcccgtgctttattctccacagggcagaaagtgatcttttaaaatgtaatcaggccaagttactcgtgggcttaaaatcctctaaggtatctcatcacagttaaaatctaactccaggccaaatgcagtggctcacgcctataatcccaacactttgggaggcagaggcatgtggatcacttgagcgcaggagttcgagaccagcctgggcaacatggcaagacccccgtctctacaaaacatacaaaaattagccaggggtggtggcgcgtgcctgtggtagccccagctgcttggaaggctgaggtgggagatcacttgagcccaagaggttaaggctgcagtgagcgaagatcatgccgctgcactccagcccgagcaacaaaacgagaccctgtctcaaaaaataaataaataaaataaaatttaactgcaaaagccttaccatggcctctgaggcctagggtcctggctcttgagaggaatcttgagatcgttcctgtttcacaacccatgctgtcttttccttctgcctgaaaggctgtttccgttcatgtttgtgtggtgcattccctcattcatttaggttggtgcccagatatcatctccttacaccatcctaactaaaataaataccccccaacccttaagtcactgataaacccttaacctgcttcatttttcttcacagttcttattgttccttgataccatataatacgtttatttgtgcagatgtttattgtcagcctcctgcactagactgtaagccccatgatggaggggacttttctccttcattctccactatttcccagtgttgttgcatagtagggtattctgtgaatatacattaatgagaggaataaattaattattagaaaaactctctttccatttgaaggctgtttatgtgggatgagagatgaatgtaagacttcatccctgggttattgaaagaatgatgcaaatgggacatcaggagccacaggtgtgaagggttgggagggacatgatattgtccagtagactcccttagcctagagaaagggtttgatgaagacctctaggtcatatagcaagcatatcagggactggagtccatgtcttctgagttccctggctggtgttctttccatgacatcatagcatctctaagagtcaggaggaggagatgaagtcaggatacagaaaagtagttaatggaagatgataaattcagcttgggacatgctgagcttgagatgtcactgggacatgcagatacagatatcatgtgctgttagaatgaaaaactgaagcccagaaatgagcacagatacatgcactgattttgtaattgaaactatggaaaaagattttcaagggcaaacaggaaaaagtaagaaaaagaagagtagggaaaagaatgcaaaggctctaacctttgcatatgaaagatgtttgcagagaaaaaaggattcccatggtctcacaaagccaagggaaaaaaggtccgtcgaggaaaagtcaagtaagacaaggactagcaggtagaaagcagtttcagcagtgtggagttaaaggtcaaattgccggggattaagataatgaagatgagggggcttagtggttaagagctctggagttgaactgcctggatttggacccagacttcagcatttactgtctgtccttgggcaagattttaaatctatctatgctttattgcctcatatactaaataggaataaaactaatacccatcacagaaaggtgttgtgagaaataaatgagataacctattttaattgcttagcccagtgtctaacacataataactactcaataaatttaggtattatttctcttgacagaagtgtgggatctaagggccaggctcacaccttcacagcaccttcggaggtcaaaatgggaggttcacttgagcccagtagtttgacaccagcctgggcaacatggcgagaccctgtctctacaaaaaaataaaaaaattagctgggcatggtggtacatgcttgtggtttcagctattcagaaggctgagacagggggatcgcttgagcccaggaggttaagactgcagtaagttgcactactgcactgcagtctgggcaacagaaagagaccctgtcttaaataaacaaatagatagacaaatagataaataaataaatgtggggtctagggggaatagaaaggtaagacataaatttgaaagattaacaggaagaagacttctcttgagtgataaaagtcctgtaaaagaaagaaaaagggaccccaaattcaggcaaagtggttagttttaaggaaaagaaattagacggtaagagaggaacataaaacagattatggggatgagaggagctctggaaagtttgataaagagacatgtattctaaagtcgccttgttagatcagttcatagcccagcttattaagagcttttgagtccctctttctgacatgccacatgttggctgataattacaacaatctgaggtgatatggtttgataagcactgcacagggctaaggatagatcaggattcaaggattagttagggtgtccaagaggaacagaaccagcagaatcaataggagattgtatatataaataatctataatataaattttctcctaaaattatatatatatacttttaatgtgtatataactttaatatatattaaaatctatatgattatatatattaaatatatgtagagagatttattatgggaattgtcttatgtgattatggaggccaaaaagtctcatgatccactatctgcaaactggaaaaccaagaaagctggtggtataattcagtccaagtccgaaggtctgagaatcaggaacccatgatgcaagttctgttctgagtgtgaaggcccagaaactagaagtaccagtgtccaaatgcagcagaagaggatgtgccagcctaaatagagatggaactcactcgtcctttgcctttttgttctcttcaggccctcaccaaactggacgatggccattcatattggtgaggatgattttctgtactcagtctaccaatttgaatatgaatctcttctggaaacaccctcacagacacccagaaataattttttaccagctttgtggcatcccttagtcctgtctgtttaatacatgaaatcggccatcacaaatccttccagtaaccataggaaagcccctgtaagttgccacggatctatcatttgacacagtctggaatcccagggttggagggtgtctgaaaggccatgtggcccaatgtcacccaaattccctggacagcatctccagcagccagttttgtatcagctgtatttggacagtgtccccactggtggctctcggcatcttgcaagcagacctttctcaggtcagattcttcagcacagaaagttctatcattgatttgccatagggcctgaaattgccattttcaatcattcctcaggcttaagcgatcaaaatatccctttaaaccacaaatacgttacctggcaatagagtaaggactgtaagagagtcctttggcagtcacatgggatgatcccaaggataggtaaattctaattagtggtgggagtaggggctaggacacaggggatgctgaagacaataagacacggctgaaagggtcaatcctggggagttgcaacatggatacacaggatattcagaggaagattaatgttgaagtcaaattcatccttcttcacatctttggcctcttctggccctagatgagtattgaggtgaactagtgtctaaagaagagccctggtctgattcattaccaccacgtacaagaggacatttcaatgactggcaatgagatagtccatttaattcattacatagtattcagcctggggttcatgaatctggtctaagtgaggatagctgaaggcattctcagtttacgcatggataagatttccaacccaagccacataaccctaccacaatccagatggagtccagcccattcactccatctgcagcactctctgagctcaactggtttgcttatctttgtgtttctttagtactttgtgtttccttatctgtaaaatactttacctattagaaggcagagagctggattagaggatctctggtgggtttttctgcttctaaattgtatgatatcagctatgggacctccaagacttgagaggtcaatgacaggaggcgggtctaaaggagcttcaaaatttcaacctaggacagacttagggttggaggagaagggaggggactgggcatggaactgcaccttcctggtaagcagctgtttttattgagattgcataagcattgggggccactggggaagttgacaagatttggggagatctaaagctctccacaagcaactccttgagccattctgaaaatagttcctggtgggtgatgtggttaattccttcagctctgcattgccggcaatctccgtcctcctttctgtattaggaaactaaaaggctcagcagtggtgatttgaacattgcaacagccattagaaaatatattttttttggctgggcatggtgactcatgcttgtaatcccagcactttgggaggctgaggcatgcagatcacttgagtccaggagttcaagactagcctgggcaacatggtgaaaccctgtctctactaaaaatacaaaaattagccaggcatagtggtatgcacctgcaatcccagctacttgagaggatgaggcagaagaatggcttgaactcaggaggtggaggttgcagtgagctgagatcgggtcatagcactccaggctgggcaaaagagtgaaatccagtcacccccacaccccccccaaaaaaagtatacctgttttcattgggatattttggtcatcactatatgcagtcatattctcttctgcctgagtgtataatgttggttaaaatttggccaaaaaaaacgtaactttgggaggctgaggttgtaggattgcttgaggcccagagtttgataccagcctgatcaacataacaagaacctgcctttaaacacaaaaaacataaaagggagactagacaattttgttgtttttttttaacaaatccttttcctaattcaaagatgaaattattactattaatggaaaataaattggtttattttgtccataaacactgtgccatttatgataacactagcattaacactaaacactgtgtatccattaatagcagttttcatgttcatagtgctttaccaacaactaattaaacgaaactattttaatttgttgccatggcagtaaatagagatacacagaaatggttgtatccatcaaattcattcttaattcctgaaacataattcagtttgggcaataaatcattattatgtagtgctataatatgtttaagatgataattactatgttcataatgaaaagatttgcaagtatacatagacacatgcaatatcaaatatttatggatgacaatttttatatttgttactcagaaaagattttcctttactgaatctgatagtcaaaaatgaacatttcatctgcaatcattactctgttcatatcttatctattatgtttgctcctgagcatccatctctagaagagtggcattagaatgaaagaggcctcaaaaaaatttgcctctgaattaacagagggatctgttcgtggttagtctgtgaggagaggggatgcagagggagggcagggagaagagacagtcactatcttcacgtatctggagggctttgaagtggaagaacgggagttttgctttgtcctctgggatccagaccagagtgaacgtgtggaagctacagggaggcaagtgtgattcagcgtgatgtgaaggcctcgtctggagtcaaaaagactgggcccaaatccagactctgtcccttctgcaagtctggctacctaaccactctaagccacaagcctgttgcagggggtcatctgggaacttccaaaataacacacccagtaaagcactgaggccttcacctggtacctagcgagtgatgcatgactgtcagctctttatgggatagtatttgtctttaaaaggatgttaaatgtagaattactgctttgcaaggcagtgactcacttctctggcacgggaagtaatgaagcagaaactggatgaccacctgttaaaaatattgtctaagggtttcctgctttgagggtgaggttgaaatcaatgatttccaggtccatatgattccatgaattttgcagaaggaagggagaaaggacgtctagtttaatcctttaaccttttctatattgtattcttgctataatgtgatacctgggggatctaggctgtaacacaatgttattgatgaaatggtattatagagagcaaacttttctcttgtagacttttatcctgaactagccttaactctgggaaaaagagccactaattctgacgccccagtctctgccaggttttcctctgagatccattagatcctttacaaatagagatttttttctcaactagctttcctaagtctgtggcccattgtgttttcacattacaaactatttcctttcatattcagaatgttttctgtatataatcacgtttccctagatatttatttatctttaccttgttgcttaacccctctatcagtgagagggcaatgaaccaatctagatttaaataacatgaccttccttctcatgtatctttctttttctttaacaacattgtatgatgaccagcttctgcccagttgctgaacgtttgtacagaaaccactaaaatccatacagttatagagttgtttgtggggctgtggtgtcaattccatcccaaccacttatgagacttcaattcctgggagtgctgctatcactaagataattgggtatgaatggcaaggaacccactaaaaaccttcaagcaaagctgagagagagccaagggaaaagggaatgagaaaatgagtactagggaggtgaaagggctaaacataaatggtacaaggaaagaaaaaaaaacagattttaaaaaaagaaaaaaaaaagagctcaaagcagagaaggaaggaagagacgttttaaattgtcctgattttcacattacatctacatagttcttggaaatggaagagaaacactattcttagagagaatcaaaagtaaacttcgaaaaataaaataggtagtaaaagacaaaagaaaaataccagtttgctgttagctgttctataatcaatcatttactagaggaactataacagtagaggcggaataaactagtatgtccggtatgtgcactttccatgtgaaaaaaattaaagtagaaaatctcacataaaaaaaatgttggttgtgtatctttctctatctatgaaataactttttaaaaatcacataacatctttttttctgaaccaaatggattcagaataggctcctgggtttgtctctctgtgtgtggttttgttccgtttgtttgtttgtttgtttgtttgttttgagatagggtcttgctatgttcagtcttgcccaggctggtcttgaagtcctgagctcaagggatcttcccacctccgcttcccaagtagggattataggcaggtaccaccatgcctagttagttttttgttttgttttttactggtgacatttatgtggcattttcctcaaataaaacttttttgaccattaaactagccttcttaatactttcagaagttatttaacaataatatgagcatattcaacttatattcacaaaaagtgagatgtaatttctacactctaacattaatgtttaatgttcatcagctataagttactaatattttctttggaaatattttcctacctgaaaaactttaatagcagatgaatgtagcttacattacaacataaatcaacttggattcctttcttttttttttttttttttgagacagagtcttgctctgtcactcaggctggagtacagtggcatgatctcagttcattgcagccttggcctcccgagctcaagcaatactcccacatcagccttctgagtagctgggactacaggcatgtgccactgtgcctggctaattttatttattttctgtagagatggggtctcactaccagttcaagacccaggctgaccttgaactactgagcacaagcaatcctcccaccttggcctcccaaagtgctgggattacaggagtgagccaccacacccagctgctttcaattttaatttgtttctaaatattttatttaacatatgaacacgagtgataggcagataaaccacatctcacttaccatgtgtgtgtgtttgttggggggtagtgcaagtggatgaactgttgaacttttaaaaataaaaattcctcaacaaactttatgtcttttatataaaataaaaggaaattatttttaactgtttgacaaatgaagacagtgtttagagtaaaatgaccaggtagggtccattggtttcagattagcatcctgtgttggtcccctcgctccaggtgttcagaggcctgagcatcccattcccaagtcatgttcagtgtgcagaaaggatttccctaagcaggctatcatttctccaaaatagaagagattgtgggatgcgtctaattaggaaattttcaaagtaaaatattatgatgtttctatccaaacaactgtatcaggaagagtctttaaaagggttttctcatctgtaaactgagattgagttagataatgtctaatgcctcttttagttctgttttagttcagttctatgagactaagtgttttgctcgtgggtttatttttctgcccctatttagttaacatacataaacaaattgatcatcagaatgtcacccattttcctcccaagtagcacccagcagcactatgatgagtcaaatatagttgttgttaatggatttgcatcctaagtctccttattagagagccttttagtccatttgttgggagggaagggaacaccctcacctacatatgtgtttgatacttttttcagattgttcttgactttgtcatatcaaaaagcagaggtcagctcaacagaaaatattatagaaggactttgcatttaccgtatagtactctgttccctatgtgatttttctccacaaagtagtatgccaaatgttattaaactgataaatgctttcaagatacttgatccacatttctttgaacaaaataattctcttccagctttcaaacgtataataaataatatgcttattattgatacttgattgagtgtagtttgtgctaggtattagtcaacggaagtaatcatcccactttaatagaaacccttaagtttcagtacatgaacacaatagaaatttatttcttgcttacttgacaaaatatgttggtgaatgtcctggttttgctggacactgataatcctacagtagacagagaggagaatgcagatgctgtcttgcagattgtaggtgctaggcatgaagtggtatatcgtgctgctggtacatagtccatttgccagaactggtagcatagccccacatagatacaatcagactgggaaatgtagtcttcctttgtgcctaggaggaaattgagatggtttgagaaacacacaggactgtttctgctatgatcttctatagcaaggagttacgtttagaaatgagttgaagaagagggacttgaaagagaaagcagcttatccaggtatatttttcataaccaaaattaggatcgctctcaaaggctgtgacaaagaccatattgaattccttggatgatctagaaatggagtggtagaaggttagaaattaagttgatacggggatggacaggataaatgataattcatagatgataaacggtaattaaaaagaggtttaattggttcacagttctgtagactgtacaggaagctggtgctggcagctgcttggcttctagggaggcctcaggaagcttacaatcgtggtggaaggtgaagggggagaggacaagtcacatagtgaaagcaagagcaagagagaaagtgtggtcggcagaggtgccacacacttttaagtaaccatatctcatgagaactcactatcagaaagacaacaccaagccatggatcattcaccccatgatcaaaacacctcccactaggccccaccttcaatgctggggattacaattcaacacgagatttgggtggggacaaatatccaaactgtatcagcagactaatacaatagtacattatgatcaaatagggtttatctcaagatgtaaatttggtttaacatttgaaaactaatcgtgtaattcaccaaaattacagcataaaaaagaaaaatcatatgagtatctcaaaagatgcagaaacaggatttggcaaaattcaatacccattcatgataaataactttcagcaaattaggcatggacaggaacttcttcaactcgacaaaaggcatgtaccaaaagctaacattctccttaatagggaaagactaaatgcttttcccctaagatcagaaactaagcaaggatgtctgttcttatcactactattccatattgcattaaaattcctgaccagtgcaaaaaggctctttacagagaataaaactctttattcacaaaagtcatgatcagctatgtagaaaatcattattaagattttaatttagaaactagtagaactaataagtgagtttagcaaggtcacagaatgcaagatcgacatacaaaaataaaatttattagtgaaaattttgaaataataattaatgaaataatcccatttacagtagcatcaaaaagcatgaaaatacttgggtataaacttaaaatatgtgtgatatggtttagctgtgtccccacccaaatctcatcttgaattgtagttccctgtggtaagaggaacccattgggaggtaatttagtcatggagatgttcaccctcatgctgttctcttgatactgagttctcacaagatctgatggttttataaggggcttttcccacttttgctctgcccttctccttgctgtcatcatatgaagaaggacatgtttgcttccccttccgccatgattgtaagtttcctgaggcctccccagtcatgctgaactgtgattcaatgaaacctctttcctttataaatcacccagtctcgggtatgtctttattagcagcatgagaatggacaaatacaatgtgcaagtactatacactgaaaactgtagaacattgcttaaataaatcaaaggaaatataaataaatggatatagagtgttcatgttttagaagacaaattgttgagattttcaattccctccaagctgacctacagattcagtgccatcccaattgacatcatactggacatttttaatgaaactaatatattgattctcaatttatttggacatacaaagaacctagaggagtcaaaacaatttttaactggagaacaaatttagaatacttacactacttgatctcaatattactataaagctagtaatgaagactttgcattattgtaagtatagagacatagatcaatgaaatggaagagagagttcaaaagtagttcacatatataatggtcaattgattttcaataaggtaaatgcaaaaggataatcttttcaagaatggaattagaacaacaggacatctatctgggaagagaggaaactccacccttaactcatagcacatgtgaagattaacacataatggctcataaatgtaaagataagagctaaaactataacaattctagaagcaaacatagaagaaaatctttgtggcatgacattagggaaagatatctcaggacacaacatagcacaaaccataaacaaaaatggcagattggcttcatttaaatttaaaacatttgttcttcaaagacacccaagaaactaaatggcaagccaaagccagggagaaaacatttacaaaatacatatctgatacataaattgtatccaggatgtataaagaattcttacaaatcagtaatagtataaaaaatgcatcttaaaaaatgggagttgggcacaatggctcacatccataatcccagcgcttcgggaagccaaggcagaaagattgcttgagcccagtgatagcttgaggctgcagtgagttacaatcacgccactgcactccagcctggacaacagagagagactccaactccaaaaaaaggtagattggcttcacaatctacacaatcttcacaatcttccaactccaaaaaaaaaaaaaaagggtgggccggggggggggggtggtgtgagaggtggcaaaagattgaaacaggcactttatgaaagaagacacacaaagtgaaaataagtacatgaaaggatggatgctcagtatcatttatcatgaagatatgccagagaaactacaatgaaatgctcagaaagctaaatgtttttttaaaagttgacaataccaaatgttggccacaatatagaatgctggaactctcatacattgcagatgggaatgcaacacagtgttaatagcatagccactttggaaaactggcagattttttaaaaagttaagttaaacatgcattaaccatatgtcccagtaatatcactccagggtatttatccaagaacaaacatgtacacacaaaaaattaaacatagatgttcatagcattttatttgcaatagccaaaactggacagtactcaaatgtccatcaactggtgagtggaaaaacaaattatgtatccatacaatggaacactgtccaataaagaggaatgactaaagatccatgtgaaaatatggatgaatctcaaaagcattatgctatatgaaagagggcagaaacaaaagagctcataccataggaatctattaatacagaattataaaaaagacaaaactacggagagctaaaactctgtcagcagttgctctgatctcagcatccacagggatgggattgctgacataggggcgtggaactttgcagggagcatgaggagggggtgaaatatcctcattgtagtggaacttacacagctctatacatttgtcaactctcattgaattgtacacaaaattgttgaggtttacactatagaaattatatttcaataaagctgattttgaaggcaaaaatttttctctggggtttctgactgtggattaatacaaatcaaaaaaccaaacagctgggttcccagaacttacaagtgaagtggctcaaaaagctccactctgtcagaattcagccctagaaatgtgttacctcttgcaggtaactcagcagttatgtccagaatgagagtctttttctttttctttttcttttttgtttttttcccttggagacctctgatctgacagaatgagagtctttaataggaaaattgagagagagctgatagatttccttcctttcagaaacaaatgtacagagattttccaatgtaagggttcataatgcgtgtattgtgcaatgagaattctatttgcagtcctcttaccaactttgtcgacaatgtttacaacatttctctctttagagccactgaaatcaaagaaattcttaaacaacatactattcttgcccaaaataagaagagagaattctttcactcactcattcattcagtaaacattttcctttctttctttgtatatatatatatttttgggtgggggggcaggctcttgctctgtggcccagggctagagtgcagtgatgtaatcatggctcactgcagcttcaaactcctggactcaagcgatcctcacaactcagcctcccaagtagctgggactataggtgtgtgctgccacagcctggcatttttttttttttttttttttttgtagagatgtggtcttgctatgttgctcaggctagtctcgaactcctggcctcaagctgtcttcccacctcagcctcccagagtgctgggattataggcatgagccaccacacctggtctcctttagtgaatatttattaattgcctcctgcatgataggcaatatacccagtgctggaaactaaaagtaaatatataaataaagtgttgtctctgtcttctggagagctctaacttctcttaggtttttgcattcacaattcagaacactgagagacagcttctgcgattagcccttgtcactgaaaacttacaaaaaaaaacctctgagagttatggagataaagattgcttttaataaagctctttaaatcctagaatgttgtaatttggcagtcaaaaaggccatccttcctattcagagaaaagaaatgaaagcctaagaatatgacggtcctatgggatatggtttggctgtgtcgccacccaaacctcatctcatcttgaattgtagcttccataattcccatattttgtgggagggacccagtaggaggcaattgaatcatgggggcaggtctttcccttgctgttttcctgatagtgaataagcctcacaatatctgatggttttataaagggtagttctcctgcacaggtgctcttgcctactaccatgtaagatgtgactttgtttctccttcgtcttctgccatgattgtgaggtctccccagccacgtggaactgtgagtccattaaacctctttcctttataaattacccagtctcaggtatgtctttattggtagtgtgggaacagactaacacaccatggtaaaagaaaacagtttctctattcacactacacttctgacactaaatgtatgggtttttaccacaccaagtaattgtccaattctctgaagatgccaactgggaatcctgaaattatgacatgatctacctggaatttgcgtcatacccgcaagttaaaatcccacaagactttccccaattcagatgccaacagtaagtctggggttgccaccagtacttctgaccaagtggccataaatcagaggttcccattgatactggggggtaggagaggtaaccccaaatgatggcaggacctcaaccctggccagtgcccaggctcttgacacctggacaagtcaaggaattcaccatcaagaaattcaaggacaccgtcaagaaactcaaggacgagtcagaaaatagtgaaagtctggagctttgtggcaaagtgaaaagacacactcaagaaaggggagtgtgagtgtgtgtactcaagagagtgagtcatgcccaacggggtttggagtttctacctttatgggtttctttaaccaaggggtggattattcatgaagatttctagaaaaagataaagatttctcagaactgtggtgtcacccatgtttacaccaaatatgggtgttccatgaactattatggcactagtgggtgtgtgatttagggtgttaatgagtgtgtaatgagatcctaggtgaaacctacgccaaatccagcaccatgttgagtctggttggtcttagtcaacttggccctcatcctgcttttcagggtcttattggtccctagtatatgcagctctttcaacagctcctttttgctagtcatgagactgctgcttggaattttctgttctgctatgactatcctgtctcactgtgacccctttctcaggattgataatttactagaatagctcacagaactgaggctcacagacactttacttatgtttactggtttattataaaagctacaactcgggaacagccaaatgaaaggaatgcataggacaggggactggggatgcttcagggttttcatgccctctctgggcacaccactctcccagcacctcaatgaattcatcaactcctaagctcataagtctcccagttcaagaccttctatagagcttaatctccagaccccctctccccttcctggaggtcggttgtgtggctgaaagttctacccctctaatcatgtcgtctttctgataaccaactccatccttgggcagtctaggggctccatcctaagtcacctcattaacataagctcaggtgtcatcgtaagtggcttctttatgaataaaaaatgaaggactcaggaaattccaagggttttagaaaccaggacaaagaccaaatatattttgttttatcccacacagttagacaatgagttagtgggaccccttctgtcttctgactctgattcaacatttcagaggcccctggcatggtcttcattatctcccttcatcactccctgcagagcagcagtgtctctaagccctgctgtcctcttggagacattccagggtacttttacaatctaaaaacatgcaagcataggtaatttccacaggttatacgtgaaataacgtatctttgggaaaaaagattataagtgaaatgcttagttcagcaaaggaatgttttctatggaatccccctttgatagaaatattgcttttgaaaacattttattattggaataatttggaaaaagtgatttatttgtgctccgagggaaatggggactttcttctcaaatgtttacaggaattattttgataataaagcattttctgattgggaggatgcagataatttttcaggcatgaaacagaaaagcagctgcagctatgtacttaggaaaaggtttggtttttgtttttaatggtcaagtcagtacagtacagtgcatagtgctgtgctaaaaagctttacactcacagaaaattaaatcagggcaatcatgtatgtgataccttgggaccaaactttcatttgtcgtttatccggtgtatcctatgtgccaaagactgtgaagcagtgctgtcaatagaattctttgtattcatggaaacgttctagagctgcaatgtctaaatacagtagccattctcagtggctcatgcctggaatcctaactctttaggaggctgagactggaggatcacttgaggccgggagttccagaccagcctgggcaacatagtgagaacctttatctacaaaaaaattaaaataatattcagtggggtgcggtaatgcatgtctgtagtctccagctactcaggaggctgaggtgggaggattgcttgagtccacaggaggtcaaggctgcagtgatctatgactgcaccacagccctacagcctgggtgacagagcaagaccctgtctctaaagaaataataaataaataaataaataaataaataaataaataaataaatagtggctatattcagtagccactaactacctatggctactgaacacttgaaatacggctagtgagactgagaaatgaattttaagtttaattttctttcaatccatttaaatttggctggccacgtagtctactagctatggaattagacagcatagctgtgagaaataggaaatacaaagtgcctgaatattcacaatgtggttgtaaatgattgagctagatgtggatggaggattgtttccagcaatatctatccacaaaggacatctctcccatctttcagaattattaccttcaaatataagactctatgatggaggtgattaacttgatatcctatgagcacatatatctacagtgagtaaacaaaatgctatgactctttcaagctaagaagtatgagaagatggtagagtgggaccccttctgtcttgggtgctactgaggtgacagtgtaatacacagcaaagtacgtccaagtggatttgggacaacatctaccccatgcacagattaaaaaaaaaaaaagggtcctgagactttgttctacaatcttggatcccttgtcagtcaaatcaaaactataaaaataagtgctaatgagagaagaacatgaggagatggtgatgacagctgttgcctggctctactctccactggaagagagctgggtgctactctccagccccaagcctagtaaaaggagttcaaagagacctgttggagaaatcccaaatggttcctggaaaacactgaagatggtggcctcgctcatgctccagaaaaccaatggaggttgcttcttcccacgaaacctagagtgagagggttgaccaaccgctttgggatagggactagggaagcccttgctatgtggatgggatcagcccacactcccagagttgctgaggcaaggggcatgtgtgagtgtctcttgtggaagagatgtgggccacatgcaatagagttggcatggagtctatcttcttggggtccacccagtagggtgggtgagagagggcaaggctcagcaggaagaaatgttccagtgggtacataggactgaggaactggaatagaggaccccacttaatatggtttggatgtttgtcccctccaaatctcatgttgaaatgtgattcccaatgtcagaggtgtggcctggtgggaggtgattgaatcatggggacagatccctcatggatggcttagcactatcctcctggtgataagtgagttcttgctctgagttcacatgagatctggttgttttaaaaagtggggtacctccccccaacccttctcctgctctcacaatgtgacatgcctgtccctgcttcaccttctgcaatagttataagcttcctgagtctcgccagaagctgagcagatgttggtgctctgcttatacagcttgcagaaccttgatccaattaaacctcttttctttataaagtaactagtctcaggtattcctttatagtaacacaaatagattaatatatcatccaccctccctttcacaactgcactcttccagttgaagcagaggagaagatttaatgctaagtcaagtttagactaaggactgcatagtttaattattgaattgacactatgcttagaggacctacaagtaagctgaataactgggcctgcaaagtttttacataatgccaggggaaagtttctcccactgaataaaaggatcacagcagatagttttggtcaaccaggaatggaacttattcaaaatcctggttatgatacttacatggatttcattagattttctctttacaattccaagaagctatgggttttttttttttttgtaacaaaaaagcaaataaaatataaatcaatttctgtcagcttggaaacctgtatattgaccaaatctgtctttttagttaattccagacgtcattatttatgcaaaaaaaaaattgggagtgagtattagtaacaccgggttgggcataaaacatagcttgagacaaactgagattgctagaattacaggcatatagcactatctctttcattcttcctgaaaataatagaacagttttggtaaaaagagaagtgatgattgcaggaggtagggagagagcagaacgcagacactgctgattgaaaactgtagaaaggaaaaggtttcatgtaaaaataatctgaacatattccattaaagaacattcttttgttttcctcctacttcactgactgctcgtttcagattcctctgcatgttcttactcatctccctaatttctgagcattggagtgcattaggctctcctcttttctctttaccatccactcctttggtgatctcattcagtttcatggatgtaaatatcatctctgttacagctcccactcctacctgtcccctgaattctggttttgtatatccagtggcttgcctggcactcctctgctgaatgttgaaaagttaactctaacttaacatgtccaaaaattacagcctgatctcccatcctaaatcttgttacttccacagtcttccccagttagttaatgtaactccatttttctggtagttcagtcccaaacccttgagtcatctttgactctcttttataatgtacattcatgcatcagcaaattctgtgagctcaatcttcaaaatatgaccagaatctcaacatttcttacctccttctttgccaccaccctggcccaagccaccatcatctcctgcttgaattgttgtagtagcctcctaatttacctccttgcttccaatacataataccgggtgattctggcaaaatctaagtcgatcatcctacccctctgctcaaaatctaccaagggcagttaagggtctttacaacaacctataaggtcccacttacgacatctctgaatacctttcacctggctcactcagccctaggcacactgaccccttgctgtgctcaaaacacgccaggcaagacctcagggcctttgcacttatagttacatatttgcatggctttccccctcacctcctttaggtgtttactcaaatttcacctctcagtgaagtcttctctcaatatcctttgcaatcatctactctcctgacgctgtactgcttatgccttatccctttccttgttttgtttttctccaagacactcagcatcatataacatcacatatatttacttatcttgcttattttctgtcttcccaagctccatgagggaagggatgctttgtgctccgctagagtcagtaaactatacctagcacatggtagatgttggataaatatttgtcacatgaatgaatgaaagaataactacccataagaaggataataaaaaataaactgaacctttattatagagacttaacctcagttattcgggtcttgggggaaaggtgagctgagtctaccctatgccccggaccaccctctggtctaacatttcttgtgcacttactatactccctcctcagttttcctcttttctccattctcttccgacccctaaggacatgaaccacatttctgctctttccttcttgtctcccatccctctcacccacccagcatacactcagcattcagtcgagtcccaccaggcaagtaccgtggtgaattttgtgtcagacgtattctctcagcttcatcttgagcttttgaaatccaagcatatcatgattttaggtatgttgactatttctgcattgggtagtggcaaattttaattgaaaaatttttttgttgagcctcgactacagaccaggcacagttctggaagctaggaatacaataacaaataaataagactggcacttatgttctgtattctaatatatcagtggtttgtatgcagttattatatgatctataaggcatcctatctgtgcacttaagcagttgtaggcagcccgcttattgaaaatactgtagaggttagagttgcttatgtatttaaaataaaaaccctttcctttaaatgcatattttaagactcttggattgcttgagaattgataataaagaggagtgagccatagatcacaatggaaaaatacttagtttttttcttttttgacgtgcaatgactcacatctgtgaaatggcaaaactcataatagagataaaaaaaaatgagttgatgagttttaagtttaaagcattaacctgaagcctggggaactcatctgttttcatgattccttccatctctgttttttttgcttggcatttatttccagagctaagtaaattacctaagctttcaccaggaataagaaacttatcttctggctgggcgcagtggctcacgcttgtaatcccagccttttgggagaccgaggtgggcagatcataaggtcaggagatcaagactatcctgtccaacatggtgaaacaccatctctactgaaaatatcaaaattagcctggtgtggctgtgtgcgcctgtagtcccagctactcaggaggctgaggcagaagaactgcttgaacacgggaggcggaggctgcagtgagctgagattgagccactgcactccagactgggcgacagagcaagactctgtctcaaaacagaaaagaaacttatcttctgactctcatgaggatagacttgggtagtcaaatttttgatgttcagacacacttgattcaagaaaaagtattttctctggttttggatcaacacctctatctttaatgcccaaacaaattccaagtggctctccacctctaccttttgcaagatgttctcagcttcagatttattagcgcatgcgtgctttcatgtacacacacatctacatatctcttaagctttcagtctaaaacaatgaattgactattggaacatttctcttgattcaaaattatatgttttttcttttattgaagtaaaatttatatacgagcaatgcacagcttttaagtgtaaaattctatgagttttgacaaatgtaacatcacccaaatagaacacctgcatcaccttaggaagatcccttatgcctcattttttttttttaaaaagagcatttaatattaatcattgcataaaaaatgaaatgccttgaaatcctacagttatatatgaaagaaacttgagaggtcttccaaaatttgaaaacatattaaaagtgtaaatgttattatcagtaataaatgcgagggtgggattttcctaaattgtcaataataaaattgtgatcaaccatgctagagaaaagactgggctatctattcaacccatagaaaatgtcacacaatcaatctaccacttcacacccactaagatggctgtaatcaaacacaaaaacaataatgagtgtgggtgaggatgtggagaaattagaaccttcatacattgctctggtaggaatgtagagtggtgcggccactgtggaaaacagattggaaataaagttatacagtcacgatataacccacaatttctactctaggtagaatggaaaagagaaatggaaacataacagctacatgaaaacttgtacataaatttttatagtagtgttattcctaacagccaaaaagtagaaacaactgaaatgtccatgaactcataaatggatcaataaaatgtggcctatccacacaatggaatattatttagcaataaaaaatgaagttctgatatatgctacaatatggatgagcattgaaaacattatgataagtgcaagaagccagtcacaaagaccacatattttatgattccatttatatgaaatgtccagaataggcaaatctgtagaaacagaaagtaaattagtgtttgccagggactgaggggtttggagggaaaagaggagcgaccgccaatggggatagggtttctttaggggatgatgaaaagtttccagagttgactgtggtgatgattgcacaaatctgtgaatatagtaaacacattgatttgtactctttaaatgggtgagttgtgtggtatgtgaattggatcttgataaagctgttttaaaaaaatctttccaatgagattatcaagagtatgtagccaggctgggcacggtcactcatgcctgtaatcccaacactttgggaggctgaggcagaaggactgtttgaggccaggagttggacactagcctagccatatagggagaccccatcttaaataaatgtaaagttagctgggtctggtggtgtgtgcctgtagtcccagatacttgggtggctgaggtgggaggattacttgagtctgggaggtagaggctgcagtgagctgtgattgcaccactgtactccagcctggtcaatggagtgagatactgtctcaaaaaaaaaaaaaaaaaaaagtatgtagccaaaatacttgaggaaaaagtattgctatggcttgaatgtccctgccaacattcatgttgaaatttaattgccattgtaataggactaagaggtggggcctttaagaggtgattgggtcataagggctctgctctcatgaatgctgttattaagagagtgagtcagttatctagagaatgggcttctgacaaaaggataagtttggaccccatttgcttcccgtctcttgtgcttgcttgctatgtgatgctttccaccatggaaccaccctcaccatgtgctgttgctgtgctcttggacttccagcctccagaactgtgagagattcatttcttttctttattaattacctagtctgtggtattctcttatagcagcagaaaacaggtgaagacaaatattactgaagtgttttaggaagtttattactacaaaatattatgtaggtggtagataaaactattgtgtgatttttctggatttggtaatgtttgtgggatttgtcaactcttagaaatttgtatttgagatttttgtcattctaaataaacgttcatgttgtactaaaaaataaatattcaataatctgggcttttcagtgaccttcagaaataggaaggattaactgtatgcatgaataatacatgatggaatttcatcttccttttcttcttttgacctgcagtatataatgtcttgcctactatatagtctctccacaccacatacattagggctcatgggaagaggtgggggaggaatatgttattggataaatatacactagcccatgcctaggtggtctgcgtgcctcctttctttttttaccaaggcgggtgcttgtgtattctgacactgaacttgagcactgggggctatggtagcagaaatggggattcttacttcatttttaatatttccaaaagcctaacaaaatatttacacacaaaatacatgctggcaaaaatgaaatgtcaatgtttatttgatttgctttaggcttcattgacttagtagtggtaacactggctaatttatgctgatcagaacctctaaccattttatctttgattatttataactggacgaatgaatgattatttaatagatgtgatcagctttataagtacaatcttaaaatattttggcttcagggataaaaccaattaaaaatttcctttgcgatggaaattggaaacacatttctgtggcttcacttatgaaatgctcctctattgaacattcactataggccaggagctttccttaatttatcatgctaataacacttctgtatggcattattaacccaattttataaatgaggaaacagaggctcagattatagatgtctatgcccaagtcccttaactagaaatatcaagtaaatctatgtccaccctgcctcctatatgattacttttttttgtttgtttatgagttggttaatttcccaggtaaaggccagtaggccagtggtcaagcctcagggtagcaactacattttgtactgggtcttacttttgatgctttgccaacaaaaccgtcaaggaaggcaggagttgactgggaataggcacactgggactgtctctgtagggtatgtacgcaagggtaaagggagatcacaaacgagaaatatgcctgtattcgtccattttcacactgctgataaagacacaccggagactgggcagtttacaaatgaaagaggtttattggacttgcagttccacatggttgggaggcctcacaatcatggcgtaaagcaaggaggagcatgtcacatcttaagcggatggcagtaggccaagagagagcttgtgcaacaagcgctcccatttttaaaatcttcagatctcgtgagactcattcactatgacgagaacagcccaggaaagacccgcccccataattcaatcacctcccacaaggttcctcccacacacctgggaactgcgggacttacaattcaagatgagatttgggtggggatacagccaaaccatatcaatgcccaagtgactggggtgcttccaaacctacacagctgctcacactgctgctctggcagggggagcatgagctgcggacgtttttctgaagttggagtgaatttgtataaaggcatacactccctcatgctggctcctctggtgggtgtccaaggcttcctttgatagatgcagatggggcagccaaggcaaagtaggtgacttatgtggccttggtgcatctcagctatgctcaccgggcagcccatgctgacatggtgggcgagatcgtggggccaccagggaacctgactccactcccatctctaagcttggccaagtcagtcacttctcgttattggggcgtcttctacctgtcacttgaaaaagactgttctttggaacaataaggcggtaacacatacacaggaccaccctgtagccggccacacaggttccgcctccaggtgcttggatctacttaacggacctcccagggggaaagatttgcggtctctccgtccctctaccaggggagggcgccgttccagcccttgcctctgcggcacagatcaaaggacggaggaaaaaaggtgcgggtccggggcactaatgttcgaaaatgcagttttaagtgacctctccccgcgcacgcactgtcggtgggggcagtcccgaggccaggctgcggggcgcctggggggactcgcctcagggggaaatggccctttcagggctcgacgggtccccgggactaaacgctccggccgcggatcggtgccgggggagcccggtcagagaggccgggaccccgagggacgcctaggtgcgtgtcccgaagcccgcgtacctccagccccggcgagacggcgcccaactcgcggctccagtcacacggcccttcctgagaggaaacaccagggaaagcacctctcacttttctcagggtgggaaaactgtgaaggaagaagacaaagcaacaggcaggttttcgctcgcgggctggaggctgggcccagggcgggcgcgcggctgcgggaggcagcggacggtccgggccgctcgagggctgcactgcgagggtctggatcgcctccagcctcccccggaggccccgcccctgccctggagaccccgcccccgcctcggaggcccagccacctcccccctccccgaggcgtcggccccgcctctccgccctccgccctccgcccccggggcccgccaccgccggcccgcctgcgccgccttcgctttgacgttactgggggccgggcgggcggctgccgcgggctcgcagcctcgccagcctccgccagggtgcgcgcgggccgccgcctctcggcagtcccgggagctcaacaaagagcacgcggcgctggccgccggcactcgcgccctgaggctgcggccccggagcgcccggcggcggtttcggcgcgcggccgggctggcgatggaagatggaaggaaggagcgcagcggtgagctccggggccggggcgcgggcgcggggtgcgcacgcggcgccgctgttcgacgtggggtttgtgttgctttgtcgccgctctgtcccccaggatcccggggccacctgggtttgtgctgtctggataggtgcagggtgcgatttttctcttcgcgcttgcttgctttgtgttttttaggagcccagcagggtcaactttgtggtgttaaggtttaggggttttagttcatacctcggctttgaaaacctcagactttggagaaaagctatcaaaagaaggcaacatgaaagaggacctcgtatgccgatctttctttgcccggtcagcttgtatttagggactatcacgtttctgtcagaaagaaagaaaaaaagactaaactaaacaaacttgaattgagcgagcaaacggacaagggaagattattcggtgcaattcccaggagcttttacagatgtttaagtcattctgttttacatgcatttaactttatccgccgttttcagctttccgttctggcgaatgatgttctgaattttttttttaaacacattaacaccgattagaggacgtgggtttagaatgttgttggtgacctaaataataaatgtttcgttttgccattcccctcgatgtcaaaggatgttaaacgcccactaggcagaggatggaatgggcaccacgatttcattttctagacactggttctcccgatagcgggatccaggatttccgctccagaataactcttgagtgggtccaggtgttggtgtagggaagacggagatctggaaaattactgtaagtgggattctggcaacaaatgcctcaatgcgttcgttgtaattgagtatgtgcaaaggattttgcaaagcccggtagctaggtaagtaggataggatttctgctttcaagaagcgtgcttgagagcttgcctgggagagacttatgcgtaggctaccatggaggatctcagaggaagcttctggcctccgggcttggaagttctcagagaggagctggcagttatgctggaccttgaaagggaggggttgattggatttttgtgagatgtgagggaaaggatgtcccctgctaaaggaaagggaattcactttctacccttttccaagaaatgatcctttcttttctgagagtatttacaaaccaagaggttttcttttcaaaaagtcatgaaattcctcttcagcagttaaaagtgcaacatgctcaacatcaccagttaagcaaatgcaaaataaattagcaccttttcaaccagtttttagtggctggctggatgtccttccacaacctttttatatccatccacaagtgatttgtcttgtaagatatttcattaatagaagctttttgtactaaaaggagtagagtggtatcaagaaagggacttggatctgtaggtaggacacctagcttagaggctttgccactgactgggtgagtttttgccaccgtcttgggcaaattatttaacttctgtcgctacagtttcctggtagggtgaggggattaggtagatgctctttcagagccttctagccctaccatttgatatttccatgcctagacacgttttatgcattacttattcagtgatgtactcttaatttcacattctaaatatctgtttgtgtgttctgtgaatggatcagcactcttatcctgaccattgaatgtgggagagtgattagagctacaaagctaaaataaccttattacggccaaattccgtggttgaatgttgttgttgtttttttttttttaaatgcgagcataagaagcttgatttgccaatcttaatgtgtgttttctttaaagaaagttttgttgacactgttcatttgtgaccaaagaataacatataccttattatgtacattgcacttaagcaattcaattctgcttttaatcagatactagtaatttaaaaaattgagtaaccttggaaattcttacaggctagtaaatcttgggaatttggaaataaaaaaataaagtaagatggaagtagctcattgaaaaagaaaaatttaaaggtactttcagtcaatggctctgccctctttctaaaaccttgatatttacatatttgtttgccagccctgatggaaaattatttgagtggaatttagcgtggcattacattgaaaaaacatgtccatggtactactacttttggaggtgattttttttcttttatagaaattcaggtgtgatttgtcatgcattattcataaactaagacaccagtgtggtgataggttaattgcagtcttggttaagagatgctgaggcaaaaccatgtgaatattaaaatgtgtatctgctttggcttaaagactggtttgtttgaggtttacatggggtaatgtcatttggacattatgaaaagagtgtctttgggtttgggttggattgggaggtgagttatggatagtgatcgtttccaatttttggaaaggaattcagacatgattgaagttgggtcagactgtaaaaaataatctggtgaccaaagtctgtggagtttagtatgtgaatcaggcttataggaggctggggatctagtgtgaccttgaattactgctgttgtgattctcaccatttaggggttcttcccggaccgtctgggccaagcacagaggtccttggcttccctttgctaagagtggaagtgttttcactttgaatattgcctctcagttcttcctagttcttttacagttaaaccagcctggctttcatttaggagagtacaggatccatgtgaaattctccagagcatttgttcggagtgcccatatcttgacagcttgtgttgtttgtgatattgtatgcagactcagggatttgctggaaagaatttaagtggtggcattattttttcaaagagtgtttctgagttacgttgaccatctttcaaggacatttttcacaagctccaaattaagtagtgttgtagtggctgttgcaatttacaatggagaaaaaggataatttgcagcatatagttaacaagttattcttaaatccaaattaccaaatgtccatgcctcatttgaaaataaggcataactcaacattaataatgaatctttgcgtgtgctatcttatttatataaaaacagtgcatgtccctgcagtgcttgtttgctctaccaaaagaaaggtttttcactgcgcccagaaggtcaacaaacttgggcccagttggtgcctagtggggagggactttgttgacacatcagggcacagaggtggcagagcattttctctcttggtgacaccggtggtgtgagggatccgcccgctcttctccccttcctgcatgtcaggctgcggccatggcagaccactcactccttgaggcttacttgaggaccactcactcctgagccatctggtttgaaattccctttcctctgagtgtacatcagtgagatgaatcagaataatttatacatgttgaaggatatttttaaaagattattattggagttagggatttaggataactgggaaaattaacattttgacctaagctggtgttcttttcttacatggtattttcacacgggtcttctgagaaagcagcattttctaagtttcttgttaagtcctgatttttctgttgttgttgttgacacaagatctcactctgtcacccaggctggagtgcaatggtgcgatctcagctcactgcaacccctgcctctcagactcaagcaattctcctgtctcagcctcccgagtggctgggaccacaggtacacgccactgcgcccagcttaatttttgtatttttagtatagacggggtttcatcgtgttgcccaggctggtctcaaactcctgagctcaggtgatctgccttccttggcctcccaaagtgctggaattacaggcatgagccaccaggcccggccaagtcctaacttttggaaaacgcttatttcgagtgatattttcctggcatggggcgtttttacaatcacagctaatgtttattgagttcttacttgggttgtctcccttattccccatgacaacccatgaggtcagtagtgtcattatttccattctgaagtcaggagaggttaaggaacctgctcaagatcccacagtgagtaagtggcagagctgagactttaaactcaggtcatccaattttcttaaccaccattctgtttttatgtctcaaagttagcattgcgtgttgcagaaactgagctctttggctctaatatttagattattcgagtcttggaatctgaatattggatgactaattcatcaccgaccattatacatttgttggcttaatagtgggaccagatttgttgtttggctcaagagatagaaatggtgtaattaaacaacaacaacaaaacccctggggtgtctaaaaggatctctgtaggaccacatgtaaggagttccacgtagttatgtgtcattaattggaattcacaataaagcagattaacaaattaaaatggaatgtattttaatttctttttaatttctaatttaatttctaattgcatcacctcagagaagtgatctagatgcttcaaccacagagggtgttgacacagtgaaggctgcttttccttgttatttcttcccatgagctggggcttagagattgttaagaaaaggagcttgaaacaatgaggaggaggatggggaatgagccgagggcattcataagaccaggcggcagctgctccctgtttccctggccttctgttctcagacctttgctaagaaaaagtgaattatagaaatcgagcagcttggttttcttatgcctgtttggtctgtggacaagagaagtagaaaattttaatagaagcagctgtagcttcttttgtttggcctctaggagattactggttaagggccagtggaactgcttttctctgtatatggaaacttacatgcttttttgaatgtagattttcaaaaacttgtactttcaagaagttatttgataggcacagttttgattgagtcataggacactaggagagtggaaatttaggtataagagtgatggcacagacgatgccattagatggctgctgtcttcgtgactgtgttattttctggcgaagttatattggaaaaatgcttggaaattgacagcaggctttgtgatcttccagagtgtctcctctgactctgccttcatgtccctacaaggtgcaagtagtgagtgtttgaagaggcaagatatttcttgcatctgaaactttgtttgaatagcaaagttacttttgggcagatttttatgtttcgccgattcatttctagtggctacaaaaggtctgtcagccaccttccccacccgctgatgcttatatctccctataaaaatctcccttggccgggcgccatggctcacgcctgtaatcccagcactttgggagcccgaggcgggtggatcgcctgaggtcagcggagttgagaccagcctggctgtcatggtgaagccttgtttttactaaaaatacaaaaattagctgggcatggtggcaggtgcctgtaatcccagctacttgggaagctgaggcaggagaatcacttgaacccaggaggcggaggttgcagtgagcagagattgtgccattgcactccagccaggcaacagagcgagactccctctcaaaaataaaaataaaaataaaaataaaaaatctcccttgaagaaaaattaaccattgctttccatgagctaatatctgaaagtatcaaggcagagtctgaagtacagatattattatgctgttgatttaagcattcagcaaatattaagtgcttacctcgtgctgagctcagtgtacactccaaaaaaccttgtccactgacctaggcaaacctcacttggatcgtactagtgcgagtcaaacttcacaatcagcaaatactgaaactacagtacctaagaactcagaacttgtgaactttatagaatcgatgcagttactgcctgaatcagcattgttcaatagagcttttactatgatggaaatgtcccatatttgccctgtccaataagatagtcagtagctacatgtggctgctaagcatgtgaaatgtggctagtgagatttaagaactgaattttaaattttatttaatttcgataatttaaatagcttcaggccgctagtaactactatattagggcaactttacagcaaaagtgcttttttaatagatggcattatctgtcctgggctgtcatttctcactctctctctatttattttttttgagacagggtctcactctgtcgccaaggctggagtgcagtggcaagatctcggctcactgcaacctctgcctcgggctcaagcgattctcctgcctcagcctccagaggagctgggactgcaggtgtgcaccaatcatgcctggctgtttcgtatttttagtagatacggggtttcgccatgttagccaggctggtctcaaactcctgacctcaggtgatctgtccccctcagcctcccaaattgctgggattacaggtgtgagccactgggcccagctggctgcagttgactttttgttgcaagctgtaggtggttccctaatttctagccctctttgaatctgcctagtatcacagtgaataatcaggtgggcagtgctatatatcaaagctaaggtgttttggggacacctgcagagctgtcttggaggcccagttgattttcattgtagatgaaattgacaggaaaaatgtctgaatagcatctgtattggcaaggattgtgctgagttttaaagataggtaagtgaaggtgcccgtgtccagtggttagaaataaggaacattctaataaggcagtggaacagaggaaaaaggtcttactctttatccccaaatactctgtagtgacaagtctggaaggtagacagtcacattcgcaggctccaggatttcttcagagttagccatgtaggagtagtcttgaggatagcagtgtgaaattctcatggttagacctctgttgaaatacattttaattttgagttttgtaatttgtggtggaaccacagtatcaaggcataacaatacaaaagcgtggggataggaagaggagaaagaatgacatctatttagtatttattatgggctaggtactatgtgaaacatagtatgtgtgagtgtgtacatgcatgcatctgtatgtatttatatattctttttttttttttttttttgagatggagtttcgctcttgtcacccaggccgggggtgcaatggcgtgatctcggctcactgcaacccccgcctcccgggttcaagtgattctcctccctccacctcccgagtagctgagattacaggcacgtgccaccacacccagctaatttttgtatttttaatagagacgggtttcaccattttggcccaggatgatctgaatctcttgacgtcatgattcgcctgcctcggcctcccagagtgctgggagccaccgcacctggcctatatatcctttatagtattgaaaggtaggtggtgtctccattttcagagggtgaaattgaggctcatggagattaaatgggatcctttttttaaacaactttattgagatattcacatactatacgattcacccatttaaagtgtacactcattgatttttagtatgttcatggagttgtgcacccatcaccatagtcaattttagagcatattcatcacttcaaaaacagcccaggccaggcacagtggctcacacctgtaatctcagcactttgggaagccaaggtaggaggatctcttgagctcaggagtttgagaccagtctgggcaacatagagtgagacccctttaatagcaaaaaaatttaaaaattagctgagcatggtgatgtgtgcctgtaatcgcagccactcaggaggctgaggcaggaggattgcttgagcccaggaggttgaggctgcatgcagtgtgtcgtgattgcatcgctgtgctctagtctgagtgacagaatgagaccctgtctcaaaagaaaacaaaaaaaccccaaaaattccagacccatgagttgccacctctccccattgctcctatccctcatcacaggcaaccactaatctattttctgagtctggattttgctgttctgcacatatcatgtaaatgaaacaatacaaaatgtggccttttgtagctggctttttcctcatgttttcagtgctcatccatgaagtagcatgtgttagtacttcattccttgttattgctgaatagtatgccattgactagatgggtcacattttatttatccgttcatcagttgatgggttgtttccacttttgacagttaggaataatgccattctgaacacaagcatacaagttttgtagccattctagtgggtgtgaggtggtatctcattgtggttttgcttttcgtttctctaatgactaatgatgatgaatatattttcacgtgcttattggctcgtattcgtccattttcacactgctgataaagacgttcctgagactgggcaatttgcaaaagaaagaggtttaatggaattacagttccacatggctggggaggcctcacaatcatggtggaaggcaagaaggatcaagtcatgtcttacatgtatggcagcaggcaaagagacagcttgtgtgggcaaactcccatttttaaagccatcagatctcttgagacttattacaatcaagagaacagcattggaaagactcaccccggtaattcaattaccttccaccggcttcctcacacgacacatgggaattgtgggagttccgattcaagatgagttttgggtggggacaaagccaaaccatatcattggccatctgtatattttctttggagaagtgtctattcagatcctttgaccgtttttaaattatattatttgtctatttactcttacattttaagcattgtttttatattctgggttgaagtctcctatcagatatatgctttgcaaatagcttctctcattctgtgggttgtcttttctgtttcttcttcctgacctttgaaataagtgaagttctttatcttaaacagagcaccagagggcttagcacagttctaggccctcacgtattttccaaagtgagttaacaaaactttcagtatgatgacttgtgtaacaaatattgttttttaaatatctggttggaagaaggatggagatttaacctttgcctgagctatttgagagggaccacaaagctctgcagacttgagactcttatgtatactgaaaggaaattttggaagccagttctctggagacttttatgtatagaaaatagtcttctcctcctggattagacagagaattgcttgaaaggaggacaccctacctagaagacccttcttgatctttttagatactgtaatgtcatgatctaaatagtgtttcccaaacttgtctgtcaagaattacctggtttcagatttctagggctgcctgaagattctggtacagtggttctgaaggagcagtcttcctaatcaccccatgcaagtcttaagatcggaatgtttgggaaactgatctcacctggtaataatgatgaccttagtggttgcccctagaacctaattagttctctttagtgggtgtggtctccagttgacaaacatccctcgccagggagattacaaggagctgatcaagccagtctggctacattgcttacctcagcactgggtcttgatccaagacaacccaagtccccaaccccccaccccctgccagtgtggtagagatgtgtcataaaaatttaagccaggctcacagacattttcaagttgtaaagttgccaccactctcttgggaggaatcctccctccttcttccctcctcttttaaaatgtgctcatattttcttaccattgctgaatctctggaggcctcccatagtcacacagatctccatgaaactcaatggggagaaaagggcatggaaagaaaaataaacattttacataatctctacactttgcttgttttatgtggttgattaggatctcctgaagaatttcaggagagtgagaagtgtgaagttgggagggggagactcacttacctgacctctttatttttgttttttaaagacggggtcttgctcagttgcccaggctggagtgtagtgactactcccaggcgccatcatagctcactgcagccttcaactcctggcctcaaacaatcctcctccctcagcctcccaaatagctggaactacaggggtgccattgtacttggccctgttcttctcttaaaggatattctgtgttaccagaggcagtgcagcatagtggttggagtgtgcccttgaattggatagtctgatttgcttctatctgtgtcaccttgggcaagttattttaacatctctgtgcctcactgcatcattacctcatggaatacctcaccaacatttagtggttagaaggggcttagacagttttggaaagacagtaagtaggcagtaaatgtgacctggatggtaggttatacttagctgagtgggaactggaattattattgcccttcttaaagtcacacacctattaaacggcaaaactggactttcttgtaccctagactgtgattgcctacaggtgtgctttatggaagccaggagaaaaattctaatacacttagctctctgtttctatgggttctgcatcatgcattcaatcaacctcagatcaaaatatgtggaagaatgttgtgtctgaacatgtatggacatctgtttcttgtcattatttattcatgtagtataacaactatttacatagcatttacattgtattaggtattatacgaaacctagagatgacttaaagtatatgggaagatgtaaatatgttatgtgcaaatgctacatggttttatttttttcaacttttaactttcagtgtttttctatagaaaaactgcacataaaagaataaagaattcatgcagtcatgccaaatgaccatcacaatcaatcttgatggtactcttcagtagatactagaactactaagttgatatatgcttgttccttaaaaagtatacctcatcaaggtgaaataaatgcgataataggaacggtaagaaccatgtgtttataagtgcctcagggtcaagctcttacagtaagaccagaaagttacacaccctagaacaccagcaactcacaaggaagacgggggagttgtcgccttccttccttggaggtctttaggctgggaaagttccatgtaggtgtgattttgcttgaagatagagatataaactttatgacctctcaaagtcactttctggccaacagctttagcagttctaagaaggaacagtttcattttgccttcaagggatgttccttttctgtgtcctaaggcagggtgatcagttagtgagagaggatgatatgtttgcaccaagctgctagcagaaatgagtgtggctcagctccagtcctggcccttctccccttgtctagtcaacctcagccagtgcagggtacccggggagggtcaccgttagtcggcctcaaaggcgctgttgctggctttcacatattcagacttcttcttgtgccttgtccacagtttctgggggatgctggggacaccgcaggaagtactgtctgtcagtgatagggaagcttctgctccttggtgaatggttggatactctttggtcatcctgagatgtctgaatcctgtcatctgaataccttccttctctgagcccggggctgctgcctccaccaaggctgaggctggagctttccttgagatccaagacactggaggaatcaaagatttttccatgtgcttgattcctatacagattcgatgcttcgggtacaaatctccacttgttagccagtcagtcaaagcagagaatttctaaaggcctttgcaccgagcagcgagaccaggcaatagggtcagccaatgagaaaactgccactcttccagagacgctggaactaaggtctaaataagatcagtgtgtcagtgtaggtgcattgactgcaacaaatgtaccgctctggtgggggttgataataatgggggaaactgtgcatgtgttgggggcaggaggtgtatcgaaaatttcctcaccttcagcttaattttactgtgaacctagaactactctaataaataaagtctacgggcctgggcaacatagtgagaccccacctctacaaaaaagaaaaaatttagccagatgtgatggtgcgagcctgtagtcccagctacctggaagactgaggagggaggattgcttgagcctaggaggtcaaggctgcagtgagttgtgatcacatcactgcattccagtctgggtgacagagcaagatcttatctaaaaaaaaaagtcattttaaaaagataatacatgtggaagcatttagcactgtgtttgcgcgtggcaggtgctcagagaatgtgtgcgcttagttccttcttactcattacatcactttgtataagagatttgagcacctttgaatccccaaatctatgaccaatccccacttatgccccactttaccgatggacgactatatgtggtgctttggcccagggtcctcattcaatatgtttctttagcgaatgagttaaaccccataggctgttacatagctaagtacaggaaccctattaagaatatacggcagagtaggtgctctgatatttagcttcgtctaacggcagaatagaatttcctgagtcagcaggatttctggcctgatcacttttttgctattggcttcacagtggcttcatctcctgttttggagacagggaattttccccattccctgggctgcttttagagcttcaggtgtgtgactttcattaatagctctcttgcaaatggcaatctaggacataaaagataagagtaatgtgttactatggatttcctcacccagctctttcccttctggcagagacttctgatagaagtagataaaggcttaggctgtgttcaccgggtgtgatgtagcagtctcagagatctgtttcattcattcttttgattgtatcaggttttttttctctctcttttttttttttcagacagagccttgctctgtcagcaaggccggaatgcaggggcatgattctagctcactgcagcctcgaactcctgggctcaagttatcctcccacctcagcctcccaagtagctgggaccacaggcacacactaacatgcctggctaatttttgtattttaactttttgtagggatggggtcccaccatcttgcccaggctggtctcaaaccactggcttgaagtgatcctctcaccttggcctcccaaagtgctgggattacaggtgtgagtcactgtgccaagtcatattttttcattttgggtgcaattcttcctaccttctcggtgtggcttgtatatcagttgttggcctctcatattgctgtgtcctgcttgggaaagaaagtctaataaaatacaatatcatattctaaaactggagcttatgtaaagataatatagtttatagatttaaaagaacttgacaggcctagaggaattaaagccgaaattttagaagcgttactaaaacaaatgtatctgtgattagtcagtgagaaaatattatcatttataaaatcattaagtaatgattcagagggaagttcagtaagattcagaggggagttagaaagataatggtaattccattttttaaaaaacttgggtggtgtagttagtatacagaggtatttccttcatgaatatttgtattttataaatattttgtaaagttttattttgcctctgtttagtaaaaaataattttaaaataaaaaatttgtcagtagaattctcttgtggccatttaatggcttctttctaaagcattccatttagcaatacacctctctctctcattatgcttatgtttgttttacataatatttaagttacataattttggtagcaagtacaaccaggacaaatccattcaggtgcaaacacaactgattcttggtaatcgccacctcagtcatgtgggcagaatttcatgagcttgctgtagtcttaagaccacagcctgagcgccaggtactgattttttcattctgtttctttatctgtcaccagctgtgagcagcaggtatgaatgggcatcagccagcatgtcttcccgggtaacttgtgtcaccttgtgagacatcctggagttggttaattggagggtggttaagaatttctgctgtatacataacttcagaaacaaaagcaaacctgttatggtctaaggaatgaaaagggttattataaggtagagacattaggacattctttccattttgttctaaaatcacttttggcatttgtctgcctcacatcacttatgttgtgtacaaagctgcttccctcctgaataatttatttctacatctaaaatgtttgctgagattattttgctttcctttcacctggaagataattttaggtttttaagaaatgtggtttataaaaatgggacccaccatgtccatctacagagtgagtgagttactaaagtataacaaaaacgtttttttctgtcttgtacttgagtccagaagttcactgaaaatgggttacacctggaatttatgtatcataactataaagtgctttgtactttgcatcataatttctctttcatctaaagaaatcaaagtccattatattagcctggctacattcacctgcttgcagaaagggtggaccttttgggacccatttttttgttttttgtttttgtggagatggaatctcgctctgttgctcgggctggagtgcagtggcaagatcttggctcactgcaacctccgcctcccgcgttcaagcgattcttctgcctcagcctcctgagtagctgggactacaggtgcatgccaccacacccagctaatttttcgtatttttagtagagacggggtttcaccgtgttagccaggatggtctcaatctcccgaccttgtgatccacccgcctcggcctcccaaagtgctgggattacaggcgtgagccaccgcacccggcccaggacccatcttttaaatgagctctggtgaagcaaggtccagggttttgagaaagcctagcacccttggagtgtttcagggcatctctcagttaagagagctttttctttacaatgggccagattttgtatgtggttaatttaattatcaaattggcgcagctttgtcttttccacggtatctgaatatatgtgcataccaagtgacttatttaaaatacaactcttttaaaaggctacagggcgtactgtaataggtcatatgcagttctgtgtcacagtcacttttccttcattcatacattcattcaacagatggtgtttgagtgtctcctatgaggcaggcattattttaggttccagggatacagtggtcaacaaaacagacaaaaaaataagtaaaataaaaattaaaaaagaaaaaaatccttgttcttacaaggtaagacagacagtgtatgagttgtgtctgcatgtgcgtgtgtgtagtatgttgacagtgtgaagcccttcagggaaaaataaggcagaggagggagtttgggagggggtggagttgcagttacaaatgggtggtcaaggatgaccttgttgaggtgacgcatgaggaaagacctgaagaaggaaggtaagtgcaccgggaagagggcacagcaggtgcagagccctgaggcagagccatacttcctgccttccaggaacagggacaccagtgtgactggagcacagtgagcagtggggtcggaccggacaccgtcgccaggtcctgtggggccttgttgctattgcaagggcttcggtttggactgagagtgagcagagaagcctgttagagagtttcaaataaagatgggacatgatctggctgatgttcttggaggacatgctgctgctgtgtctcatgagaatagactgaagcggggaagagtggaagtaggaaaaccagttgggaggctgttgtaacctaggtgagtgagggtggtggcttggaccaccatggtatgttttgaaggttgagtgggaaggatattctcattgtctgaatgtgggatgtgagtgggagaaagcatgggtgacttgcaaaatactggcctgtgcatcttgaaggatggaggtgcattaactgagatagggagaagctgattttggaaaggatcaggagctcagtcagggagctgtctggtaggcaggtggatatatttatctggattacagaggaaggggctgggttagaggtgaacatttgagagttgtcagaatatacaaactggatgaaatccacagggagcgaatgtcaatagaaaggaaaagaagttgagggccaaaacctgggctgcttccacactgagattgaagagatgagaaggcaccaataaaggagaatgaaggaaagcagcgaatgaggggaatcgagagtgcgaggtcttgccagccatgtgaaaaaaccacttcaagcaagatgagtcagattctcccgggaagtaaagtaaaatgaggggcaaatgagatttgacccagggatttagcaatggagatgtcattgctgaggttgataaccaactgggattatagtgtagtagtggggaccaaatgttgatcagtgggtatgtaagagagcgcagaagtagagaaacggaaacatcaaatgtagaaaaatattgcaaagatttttgctgtaaagagaatgtgagaaatgtagctgcagggagaaatgaggtcaagagatgttttaaaaatgcaggaagtaacagcatgttcgaataccaatgggaaagacagtaaagaggaaaaaaatatgatgcttcatgtagtagcataattcccaaaggacctttggtgtaatttaaaacagcccaaatcatctagcttactgttgtaaacactaatttttgttaatgctgttgatttttttcaacataaagtccttatcttcccatctccatcaaaaatcaaaactgtttcttttgtctgagccgttaaataaatgtcttttgggtatgaattgtgtctgctcatcttgttcaacctcagggagtccctagttctgttaatagttatgcaatatgcatggatctgaggtacactctgtccacatgttttcagtaactgatgacttctttagctctcatctgaggcacagattccccaccgtccattaagcatgtataagatcacattttccaagaatttattcagtcaactaaatgttcattgcatgcattaaacacaaaaggccccatgtttccaggtagcaaccacagggcaacagatgggtaataagagtaagaatttaaagaaaccggtgtccttggatcttgtgtggatgaccagttgtttcccagacattactgtggaaatcacctggggacattgttgaagtgaagattctgattctttagttctggagtggggcctgagatctgcatgtttaacaagctactaggtgatgctacggatgctggctgatatggtttggctgtgtccccacccaaatctggtcttgagttgtagctcccataatccccacgtgtcatgggagggacctggtgggaggtaattgaatcatgggggtgggtttttccctgctgtttctattgatggtgaataagtctcacgagatctgatggttttataaaaggcagttcccctgcacatgctctcttgcctgccactatgtaagatgtgcctttggccgtttgctttcctccatggttgtgaggccttcctagtcaagctgagctgtgcatcaattaaacctctttcctttagaaattactgagtcccgggcatgtctttaatagcagcctgagaacagactaatacactggtgcacctcattttgagtagaaagagatcttagggtaatacttcctggtttatttttcctccttagattttgcttctgctcttcctctacttctctattattgccacattgggccttttccagctggaactttcagactcagaacaacaatatattgttgtagcatttgttgatagcatttcagtatctccgctttccactctgcatttttattgatctttgcaaaaaagctactggcgtctgggagttttgtttagtaattagatagctgaagagactaggccaagtttcatttgcattatgtagggaaggccagacttctgggtctcattcacatcccaaggccatatttgtcctagacctctgagtacatgctttggagctataggcaaagtcccagtactggggccaatttgccagttcagttgtcagcttttaaattctctggattcctacttgctaaggccaaatctcttcagtaaacagctcccttgctggaaagcagtcctttggctttgttataaataaattttgtcagcttgtggaaaatagaataaacctttgaaagtcaccactggctaatgaaagcttcttagatggctctagactggacgcggtacttaaaaagtacctataaaaggatatgtctcggtgggggttggagaagagtttgaaattaattatctgaactctgaaaattcctgtaaattctacatttagtttctgctatactttagaccatagatcttgtcctgattttaatgaggcatactttttaggatcttctgtatgggtgctattcaatagaaatatgatgagaatttcacaagtaagtttaaattttctagtagccacattaaaaaaaagtaaaaagaaatcaatggaagtaatgtaggtaatatattttatttaacctactgtgtccgaaatattgtcattttgacaaaagcttagtgataatttatattctttgcttgtacttagaaatctggcctatattttacactcacagcacatctgccatatttcaggtgctaaatggccccatgtgactgtcgtattagacagcacaggtgtatatgcagagcagctgcaggtatgacaagcacagttttatttgtttctttatctcataattctctgttaataccaacacatgatttgctgtagtgaggcatatatggttagttaagtattaaaataaagatggatttttttacagtaatcttaaaatctaccgtaaaaacaaatggatgtttcagaaaatagataattataaatatgcagagaatacaaacatgttgattgacttcagcaatggctaacagagatgaggacctataaaaattgaaaatgtctgagacttccagataatacatttttagcaatgttgtttaggataatttactgcccctcataaggtagataggtcctgtcatgactcacattttatagatgtgaagcctgagaccagagaggttaagtaatttgccttagatcacacagtgggtaagtggtagatctaggatacggaactctagtcagtccggttccagagctcactcccttcaactctgtgccagactgccttctcagcacatgtcagtgatacatacatttgcttcatcttttaaatggtatgattgagggatagtgctctttagctgaaaaaagtgattgatataatcaaattatattgatataatcaaattgtttgatataatcaaattgttctggaaaacagaggataaattaactccttaaataaatcataccctgtttgccattaatttaagtcttaatttcagagttactttatcttggtttctgattgatcttcgatttaaattgagcctcagcattttttctacctatccctgatgtggggaaaaacagctaataatgtataaggcaaactttcagtgttattgagagctaaagcatacaactgaattggggggataagctctaatactcatgaaatagtattacaatttattgttactagcaatcacagcagcagtagccatttattgagaggttactatctgccaaaccttgtgttaagactttacactcattatcttatttaactgttaaagcaatgctgtcaagttggttttatcttcatcaataaataagtgccagaaacagtgccactatactctgaaacaatgagactctgagaattattttattggattctgggtgtcacatttaaagggggacattaacagtgaacaggtatgtgagtggtgaaaaaatcatgtgatgtcaggagaggtcatagaactgtgatctttaacctaaggagagaagacttagtggacgtaatagttaccagtaagtgtttggaataaagaatatgatctaaagagaaaactgactctggcaaaaggagtacactcactctgtctttctctgaggactacagaaaagacatttacaagattttcttattttggattttaatccaattttaatgggacagaggctatgtcactccctagatattctggattaaattattgcatttggaagatttggattatacaagaaattaggaattgacctttggatgaggtgtctatttctgattttgtaataaattgcgtcctttaatcagattatttttatgatagaaataattattgagttgttttgtcaattaagttggagattgtgattaataatacaatatcagagctcagacggaccttagaaatcttggagtctcatgtcattttgcaaatgaggaaacagaaagaaaatgaattaaggacaaagttggacaagtactcaggtgttgacttcaagtccactacttaaaaaaaattatggtttctaatgtatggatgaagaagactgaatcatttctagtacatttttaaaggtcctgttgaatcttcttcagagttaacaaaatgaagtagcctgaagttcatttgttctaattagggcacacttgagtcctttttggttatcttatctgaacttggagttcagtgattttcctaaagaaaagctttcagttcgtcaacttcttttattgttagtgttttatttccctggaaacttgtgcatctttttattgaaaggataagaaaggatatagtggctctctgaatttatccattcattcaacaagtatttattgaggtgtgtgccagacacttccaagcacaactgtagggtcattagcttttactgtgagatgagaaaccatcaaattgttttgaacagaagattagaagattttttttttttttaagtatcactaacaaattaaaaggattccctgggagtttcagcaagctatagtcccacttgccttgatttaatgagacataccttttgatctcagcacacaattgggattaactgcagtttgaggtctgatccttattagttatataactgaattcacaataaagcctgaaactttttcataaaaacagggtataaacctgttaaaaatgttctaccatagactggtttggaaaccattatgaattcatgatggaatttgaccgacctaggtttgatggacattttcactgatgattcaattttgggcaaacgtattagtttttctgagcctcagtttcttcattagtacaatgagggtaaaacttgttacgtaggagtgtttttgagggttgaatgatttaagggaaatcgtgattgtgaaatgctcagccccatgtctggcgcattgtaaatattcaataaaagcacagccattattttgataatttagtcaaggggattttaaacatggataaaagttgttttgaagctagattgagggtgctaattcagacccttaatttatttttactttagagctcagacaaaatgtctttaatgcctttgtctaaaggtcctgacattgaaacaagcattaaaatgacacctctaacttaattaacactgtttgttttgcatgtatatgaattagtctttttaagtgtcactggctgttttggtggtgtcccaaattgacaaatgctccctccctcattccacaggtattaccaattttggaccaattctggtggttcagctatcaataaaagcagtcagagaaggccctgcctgtaggtcacagttgaccctagccacaggacacccagggaagtggtgtactgtgaaacctccccagggagtttcaggagtgtgtgtgtgtgtgtgtgtgtgtgtgtatgtgtgtgtgtgtgtgtgtatgtgtgtgtgtgtgttttctgttgcccaagattattgtccgagagagtaaacacatcaccttatgactctgtagccaagttcacttctgtagtaattttttgtttgtgtatttttaccactgaaattcagtctgacttagttcaatactgcatctaaaccagtgtgtggtcaaaagtattaaatttgacttgctaatctccacgcgggatgagggagagaccctatgtaaaactgaattgggcccatgtaaaacccgtgtttctggtgccccattttccttgggctctggccggcagcttcttctaccccagttatgtatttcactttcctggggctgaagtatcagctagctgagctgataaatttatctgggttaataggagagagtaagaggatcatctggtccttttaactgtctttggaggcaggattttgcttcccccactcctcagttatttgaaagcactttggcaaaactgagatcactgcatgactgttagtgtaacactgcagcttggttgatctgttcgtgaatgtgatcatcaggggaattacagatcatggaaaggtaggtggaggacaggcctctggagaaggtattcataggcacaggcaaccttttctgattgtgtaattactttaaaatattctgttttaaaaaatttcaattaaaatttgtttccttattaccagaaatatcctggtaattgtagattgcccgggtggggatgaggagaagttgccagtttaagccaaaccacatggagtgagaatgagggaaaggtgacttcaagaagaaaaaaggtgttctgttaccaggagaaggattgctggccaggcaggaacagcagatgtccctggcagatgaaatggcgctggccagaggaagcatatgccgtacagaggaatatcaagcacaatggccatgggcagaaaagagcgtcgcatatgaagaactgagagaaggccaggcggcggagccaagtgaggaagagtgggtggagcggtaggaatgaaggcatgggattgcaaagataagctagggccagaccatgcagggccttacggctaaaggagggtacctggattttatcctgtgaacatggaaggtcactgaagaggtttaagcagtttagccttttaaaaaaatcactctggatgccctgtgaagaacggattgaagagggcaagaaaggaagcagagggattaatcagtgagcttttgtaggtgagagatgaagatttcttggacagggatggtggcagctgtgatacagacaagtggaaagataaatgagccacattttgtgtagatcaacagaacctgatgattgatggggtgtaaggaaaggaagaatgacatagatttctgcctcaattaatggggattcttggagttgccatttattgagatgtagcactcttgttggatattgctttgtgttacatccttccacctagactataagcttcttagatcaaagataaggcagcatttcatctttcttcaccattgattctagcacagtgctgaggcattagaatagccacttggttgggcatatgtcaggtgggaagttgatccaaaccccacttgcagggtggctcttgagaggcagcttaaaggaataaaaagtgccatttgttaggatatttattgttgttggtttttagatttgtttgagatgatgcaagttatgtaagaagaaggtactatgagcatagaaaatgtaatcagacctcagaactaaggagatttgcccaagataatttattaatagagctgggacattctctaatccctagtattctcattaaatcatctaacctatacttgctattttgagtaatttttgtttcctgactaaaatctgtgtttcttttttctttgatgctcttctacatgttaaaaataaaaccaaataccaaatttattcacctttgatgctttgagcttctcagttccttctggtctctttttgtttttctcctttccaaaactcattctgaaggacccatgaaaagagactgaaagcagaagaaatctgtccagtcactcagcaacacctatctgaggtaataaggcaaatgaaaccacttcaaaaattgtcctagaacaaaaaatggcttctagaacattgtgcagtgtctagctccagtgcacaggaggtgctcactggttattgagactcagccccgctaccttgtgtttttacattcatggcctttgtcatctctggcatgctatttatttcttcataagagaattttaaaactggaggaattgaatagaggccgtctgaaaaaagaatacctacggaacccaatttatctttacctggagtcccgaccatgcaggctgctgtttattagaacacagtgacagtcacatggtgggctcggccctggcttgcagtcagctttgaagcccccatggcaaaatggcaagcgcttacattcccggacaaacacacgctttttattccatgtcatttttccattgctgtagacttgtaaaacaatggttaagagaatttcagaaaccaaagttattttccctgctcttatttgcatatttctgttccttaaaagtttctaaggtaaaaaagtccccaagtttggggactctcttccacaccttcaaatcaacactttttaaacatgtgatagtgtcattaatgttcttgtgaacaatggcttaagtagtgtgattggaaatagagctctggaggagcttggcattgggggttgggtgagcatttttgagttgggtaattagtcagctacaaccatgtagaacagaagtgatgattagactaattaggaaaaccatttcctaagtgctgtggtagacccaagggcaatggcctagaaatgccgccttccctgatttatttgattgatgaaaagcaggttttccacttgcgggcttatttattttttaaattagagatttgtttgtctcattttcatctgttacagttttatttccaagataacagagaggcaggagtgtcttattcgcagtttgggaatagggctttcgtgcttttcctttcattccctttactacacgattctagtggagcagatttatcagggcacttttagtcaaatctttgcaaaggactcacatgttttatgtattcagaattcaattcaagcagcttttctagtgacaggctgctttctggtctcctttatacacctaacttattcatgtgtatatatatatatgtatttatttatttattttttctaacattcattggtgcttactttgtgccaagcactattaaatgcaagggattcaagtatatctagcaattaagggctttgttttgttcggtgttattgccccattgctagcatggtgcttggcttatggtaggtactatgtaaatatttgttgaaagaatgaaaaacttaaagcctaggcccttgttttgtattttttgtgtacactcagatttagattatgtaattgcagctcattttgcaaaacggatttattattttctttctttttctttttttttgagacagggtcttgctctgttgcctaggccggagtgcagtgatgcagtcacggctcactgctgcctcttgggctcaggtgattctctcacctcagcctcctatgtagctaggactatagcacgtgccaccacacctggctgacttttaaaaattatctgtagagatggggtttcactgtgttgcccagggtggtcttgaactcctggcttcaaatgatcctctgccttgtcctttcaaagtactgggattacaggcagagatttttgggaggccgaggcgggtggatcacgaggtcaggagatcaagaccatcttggctaacacagtgaaaccccatctctactaaaaatacaaaaaattagccaggcgtggtggcgggtgcctgtagttccagctacttgggaggctgaggcaggagaatggcgtgagcctggaaggcagagcttgcagtgagccgagattgcgccactgcactctagcctgggcgaaagtgcgagactccgtcttaaaaaaatatatataaaaaaaaaaataaaaaagaaaataaatttctctaaaataaatctcatttatttcctggtagttttaaaatttaagctaaacctcaaaaaattttcttctaaaacataataaataataccgtgagtgttgtatatcttttaaaaacaaaagggtggagtgaaaatgttttaccaaattattaggtatagtttgcaaagcactattatgcatagtatgttgttcgcctccctgtgacggcaccattaacccatttgtgccggaggttgcaaattttttttgtgaaaagatcagaccttggcgatgaccttgagcagtaggatatacataactcccacaagcttagcgttccattaatggaacactaagcataaatgggttaaagtaggcccacggtgtgtgaggtccagaaaagtgagttgatttttttcctcaagtcctcatggattaggcgtgggaagaagttccttatctgcccactgctggctctttgttctgcctcatcttggtcttcccttaatggagtactctcttttgtacccagtttgcaaatggctacgttagcccgttgggtttaaagaatactttaggggcattcagcgataagtgaagtgtctaactcttcaaaaagagccatagtaatatatctgctgaccggataaggaaatacagcaccattaataaaatgcttgtgagattttttttttcaaacattgaactttttttttttttttgctgagaccattttatctcaagaaagagcttatggacttcctgagaatgtgtagtgaagcagaaaaagccagagagaccttactgaattccctgatccttgagtgtatctttcggatacaaaatggggtaataataccaaccttgcaagcgtgttctgggaattaaatcagaaacacagtgcaactcatatgaggtacccagtatttgacagtaaaggcaaaataaaagcactaacaaaaacaagtgaaaaacttaacaccaaggggcgaaaacaatttatgtgcctttgaaaacttgataactgaagttctaatgacagtcatttatatctattcattaatgcagtttctccagggacctctactgttaatccaatttcagttattctctgtatgtgaaagcatcaaaattattttctttttaagataaaactcctaaattcattttgaccttgcacaattaatctaagttaatgaggttttgttacatcattatccaatgtgtattttaaggttctactgctgtgctaccctacattttgtgacctaggaattttagatacaactgtaatcttggtctttaaatagaactttgagtaacaaagtgaggtaggatattgacagcaaactataataataaaatgtaattataatataatactattaatttagagttagaaagtatccattaaaaaaagtatccatgaatgtccaaactaaataggaaatatttatttggcttctaggaaaatgaaatacatcattctaatattttaatatttagaaagaaaagatctcattacaacttaaaaaatgattttttactgataagtgccattgacttcattgaaatgcctgcttttagtagtcaaatcccagaagaaaatgctatttttaggagtatgtttaactgaaaaagctcatatttctattcaagtttaggcaattactcttgacaaaagacaagtaaactaatgtttcatgataaagtccccaagtatctcagacttaagcaaagaccccaaatcatagtttgtagctttattgcagctttcattcaaaatatgttttatatcatctcttaactagggaattcctggtgccttcctattaggataaataagcaagaaacacaataggacagtgattgtattcttaagtattagggaatttagggccccagatattctatatgcagacctctgtgcttgtgtttgttcattttaatgagactccaaaggctcataattttacaggaggtatagtgtttcagttccagaaccaggtaaagacagggcagccctccactctataaaagcaaaggatgaccgggcgcggtgactcacgcctgtaatcccagcactttgggaggtcaaggcgggcagatcatttgagctcaggaattcgagaccaacctggccaacatggcgaaaccccatctccactaaaaatataaaaattagccgggtgtggtggcgggcacctgcaatcccagctactccggagactgagacacgagaatcgcttgaacctggagggcagaggttgtagtgatccaagatgacgctaccgtactccagcctgggcaacagagtgagactctgtccccccaccgccaaaacaaaaaagcgaagcgtgatgggtcagggttaggaccatttcctggtgacattgagctggttaagttggtggatctatgaggggaaactggctgccttcacagcctccaaggtctttgccttgtgcactgcagcttggccgtactaccccacagtcaggttggcagaagtatgatcttttttgtctgtcttatgggataatagtgaatatttacttttattatttggaaaatttcaaatgtgaaaaaatttaaaaacctcaacatttttgtagctacaattaaggaattataatacaatttggtaagactacaaaattcacaaaattatattgtggcctcattttaaaaactgaaagttgttccttcaaatgctcaaatagtttctttgataacattttttgagagcattctttaaaaaatgtattactgccccatttttttggtatttttaatgtatgcacttaatactgtttaactttttaaaataattctggttgattgttttcaaatattttaatgcagtgatgttgtcttcatgggctataaatttgtaccataatgtaaagacattatgttaggatcattttaatgtatgaatacctgggctttaagtaaggatctgttgagaattgtgtagttcagttatgtggtttaacaactagagagtcagctctattgtaaacatgtaggcatagcttgttttattgtgctttgtagatattattattattattattattattattttaattgaagggttgtggcaactttgtgtggagcaagtctttcagcatcattttcccactgtgctcactttgtgtctctctgtcacctttttgtaattcttgcgatattttaaactttctcattattattattatacctattgttatgatctgcgatcagtgattttttttttttttttttaaataatgagatagtgtctcactttgttgcccaggctggagtatggtagcacaatcatatttcactgcaatcttgaacttttttgggctcagatgatcctcctgtctcagcctccttagtagctgggactacagcacatgccaccatatccagccggttaaaacatttttttttttgtagagacggcgtctggctatgttgccctggctagtctccagctcctggactcaagcaatcctcttgcctcagcgtcccaaaatggtaggattacaggcatgagccactgcaccagtcagtgatttttgatgttactcttgtaattgctttgggacaccaagaactgtgtccatgtaagatggagaacttaaaaattgtcgtatgttttggctgctccacgactggtccttcccctgtcccgctattccctgagacacaacaatatgaaattaatccaattcataactatataatggcctctaagtgttcacgtggaaggaacagttgcatgtttttcacttgaaatcaaataaatgattaagcttagtgagaagggcgtgttgaagccaggccaaaagctaggtctcttgcaccaacagttagccaagttgtggatataaaagaaaagttctggaaggaaattcaaagtgcttcttcagtgaatatgtgaaagataagaaagcagaagccttattgctgatatggagcaaatctgagtcatctgaatggaagatcaaatcactacaacattcacgtaaaacaaaacctaattcagagcaagcctccaattcttggctgagagaggtagaggtaaggaagctgcagaagaaaaattggaagctagcagacattggttcataaggtttaaggaaggaggccatctttataacataaaggtgaagcagcaattgctcatgtagaagctgcatcaagttattcagaagatctagctaagaccattgatgactgaggctatgctaaacatcacagtttcaatgtagacaaaacagccttctattgggaaaagatgccgtctggaacttacatagctacagagaagtcaatgcctggcttcaaagcttcaaaagacaggctgactcttgttaggggctaatgcagctggtgacttgaagttgaagccattgctcatttaccattctaaaaatcctagggcccttcagaattatgctagatctactctacttgtgctctataaatgtaactaccaagcctgtatgacaggacgtctattagcagcatggtttactgaatatttgaagccaactgttgaggcctgctgcttagaagaatatttatttcagaatatcactgctcttcagccatgcacctagtcacccaagagcgcttatgtaaatctacaaggagatgtatgttgttttcatgcctgttaactcagcattcattctgcaaccaatgactcaaggagtaattttgacttttgagtcttattatttaagaaatatatttcataagtctgtagctgctatagatagtaatttatctgatggatgtgggcaaagtcaattgaaagccttctgaaaagaattcaccattctagatgccattaagaacatttgtgattcattggaggacatcaaaatactaacatgaacaggagtttagaagaagttgattccaaccctcatggataactttaggggtgagttcaagactgcagtggagaaagtagctacagatttgatggaaatagcaagagaactagaattaaaaatggagcctgatgatatgactgaattactacaattccaggatgcaccattagtggatgaggagtagcttcttatgaatgaacaaacaaagtggtttcttgagatgggatttactcctggtgaagatgctgtgaacattgttcagatgataacaaaggatttagaatattccataaacttagttgataaagtagtgtagggtttgagaggattgacttcagatttgaaagaagctctactgtgggtaagatgctgtcaaacaacattgtatgctacagagaaatcttttgtcttaagagaccattgatgtgacaaacttcatttttgtcttattttttaagttgccacagccacctcagccttcagcagctaccaccctgatcagtcagcagccatcagtaatgaggaaagaccttccatcagcaaaaagattacaacttactgaagcctcagatgattgtcagtattttttttagcaataaagtattttttaatcaagatgtgtacattgacattgttttctttttagacagaatgctcttccacagttaatagactgcagtatagtgtcaacaacttttatattcacagtgaatcactggagtgattcactttattgtgatgtttgctttattgtgatattcactgtattgttgtggtctggaattgaacccacacaatctccagagtatgcctgtatatacagaatcttaacaggaagtcttctaaatacttttcaagtgctagcttacttgttccttataacaacctgatgagtttgttttatggttatctctattttccaaagacacagggatgttgagtaccttatccaaggtcacccactagtaagtgatagaatctgggcttcaattcatttagtctggcactggagcctgcactctttaaatcaccatagtagtctttctgcttcaataatgagtggactttttttgtatgtgtgttggggggtgacctgtgacttttcttgcgtctttcctgatttttacatgtcttgaaaccactatatttcattcatctgttcattcaacaaatatttattgagtatccattatgtggtgctgagggctagcagtgtcctggtggacccttatgttacagcctaggtgcccagcagtcattgactgttttaacttaatgtctaggagggaagacagacataacaaagggaaactcacgggggaggggagcagggacaggggagccagggtgcaaataactctgaaactaggacctgagaggtgtaaaagatttagccaggttgggaagagggtgtgaggagaagagggtggtattccagttgggggagtagctaagtgcgaagaccagcgatcagaagctgtgaaaagagttcagggaactgaaagaggttcactgtggcggaagcactcagtgttccgaattaggagtggggatggtgaagggtgtaaatagtattcaggtgttttaagatcaggcagaagcgtcaaataactgattaactttacactttgatcagttggatatgtttattgtaatttctaggataatgaaagcccaaaagcagcatatagcatctaaacttgagcgtgtgtggagggagagagggaaaaataaaaacaaaactaagtcaaaaagaggcaagaaaggagagaaggataaaatagatgagatgaatagcacaaataagatggtagatgtaaaccctaatgtatttgtaattatattaaatgtgtatgttctaaatgtaccaattaaaagataaaagattgtcagactgataaaacccaaccaaccaaccaaccaacgaaccaaccaaccaacccaactaggtgctactttcacttgacagagagggaatacctccaggagatgagaaatgacaagaggtgaccataagataagctacctccatctccttccctgtctgtctaccctggaagccaccacattcttaggaaagccactggacttcccactctaagtgcagcggaggtgatcctgggagattagcactgtctgggttactcaggtctggctttctcaccagcttgtgaggaactttttggcagaggtggagtctcactcacatacctcgtgccttccatagtgtttggcagacagtaggtctttaagtagcatttatcatgtgtgtacatttgatttccatatgagattgtaaactctttgcagggcagagaacctgttacacctttgagttttccataatatctgctaaaacatagatcagtgtataattgccaaaacatagatcagtgtataatgagtgattcttatttaattctgtcaagattaaatctgatttctgtagaaggatactgttccacctttcaatgatttggaggtttgtttccacagcagagaagaaataaaaaccactttctgcaataaagacctgataacctactttttcttaagtagattttacagtaggagagtatattcttttatttgttcttttctttcttttagttgtagcaagaatttctattaaactcctctcattgggccagagactcttgtggtgttagtgaaaaacttgtcccttgcgtaacaccctgtctacacttgtgagttcattggccagtcactggcctcaactccgagctctaacaagaagaatatattcatttttattttaaagagcatgatttatttaatataaaaataaatgcttcactcatgtataagctgtaaggagatattagtagtaaaataataaaaatattttccttggaagaactgtgggcagaccatatcaaaacagcaatttctggttttggaatgaaagatactattgattctattaatccaaatgccaacagttctctggttgagtaagaatgtgctccctaagagaaaactcacttggcatcatgtaagagctgctcattatgaatagaaagaaattacataatccaaagtgaaagcaagtcattctgcttttaattacagtgtataaaaattaaaacatgggccgagggtctagttggatatacttcttggcaacagacattttggaagcctgcaatgaaaaatacaacaaagatggctatgtgctggccgccccccagtgtcttggtggtttcccgtttagtgactgtattcagttattgtgaaatcacagaattttaaagcaggaaaaagacctcagaagtctcttcttacccattcgtcctccagatgagaaaataagcccacagtggtaaagggattatagtgaggtcatatagcgaactccagaaggaacacaggcatctggactcctgtctggctttctttgagactgaactgcttcactgctgcctggaagctcttctgtggttgtggcttcttgctggccttagtgtagtgataagggggtgggaatgagggtagagggtaggagagaggaagggagagaggttgaaagagagaatgagtcattgtcattgagagggattgagagacagagaagatgatagagaaagacgtatgtctgctttgctgcttctcagaagtggtaccaataaagcagtgctctgaagcagtgtctgctgcatcagtgagctgcggagcctggcagtggttgaggtgtgggaacattctatacctgccactggctcctcctcattcctgcgctgtaaaccccatgttgaggttactgtgtctgtgtttattgcctctagtccagtccaaccatagatgtagccatctcaggttatggagagatgttaaggagaggaggggcaaattgaaaggtgcatgttttagaatttgttaattttcagattttttgaatcttagcaaaaggatttcctgagtataacctcacgtttccctttctacttccaaatctgaacaaaatcctgtgaccttccttgcttactcagagctggacatagtaagagaagtcatcatgcaaaatgattttctggaagtattttgaatgttttagttattctttcccagttcactcagagtccgttatggatttgctgctgtgaaaaaagtgttgaaacccagcgtgtggacgtgcagtgttgcttttagccttgcaggcagtgccctctggccttttcagcaaacttcagctctgagctgtgttacctgctttggctcctattgcatttacctggggcgagattctggctttcaaattcctccctaaagtcaggtgggagcctggcccaatggagaatggcagtcttaggtactgatgatcaattgctgttttccttgctagcgtcatgatatcgaacgtatgggttctcagtaaatcatgtattgttcacttgtttttgctcaaaagtccatctctggttacatcattggaagcctctcagtttaacctcttcctttgtgacttctatgcttggaaataaattacgacagttaaaatcttattgcataagtaatgtgtgttgattttaggaaaatcagaaaatagggataagtaaaaagaagaaaatataaataatttataatccatctcccagagagaccactggtaatattttagtgcatgtctaaatttttaatgtacacttatttacataacattaaatatattttaataaaaatgactttgggctgtatatactgttttttactaacatttctcatatgacatgttctatacatctctcatatcagaatacaattttgtattttcaaaagacaaatctctctatctttttaaatacagataagcataaagaaaataaaaaggcccattatctctcagtccatgtgacatgttaaaatgattagtaataaagcaaataacattagttggctgctgactatatgccagggggactgttttatctgttagctcctttaatccccacaaaagccatcagaagtagttgctattattaatcctgttttacagatgaggatactgaggctaagtgtttaattcccaaagccatacagctagtaggaaatgagctcagatagtctggctcaagaacccaatttttttttttttttttttttgagatagggtgttgttctgttgcccaggctagagtgcagtggtgcagtctcagctcactgcaacctccgccttctgtgttcaagcgattctcctgcctcagcctcccaagtagctgggattacaggcatgtaccagcacacctggctaatttttgtatttttagtagaaatggggtttcaccatgttggccagcctggtctccaactcctgacctcagatgatccacccaccatttcttaaccacactcataccgttagactttaaaaacaaagtcaaacaatagtctttctctattttttaaaaaatctttctctatcagcatgtacagaactacctcattctctataacagccacatatacgtcctttgtatactttggtttaactgtccccttaactattgatggacaatttgattgttttcagatatttgcaattacaagcaatgcggcaatattgtcatactaatggtactgtttattgagtgataaaatcagctactatggataaatgcatagaacagtgcctgctacatagtacgatctgtgatttatattattattagtaatactgcgtgccatgcactatgcttgaattctcaaaatatccctatgaggtagattattgttattatccctgttttacctttgaagacattaagacataatgaggttaaatagttcttgtgtcatgtagtaagtgaaatctgtgatttggacccttttggaacttggctactgctaactacatattcccagcttcaagggggtcagagatggagaaagccttggtattggtaaacattagtaatgtccacatatactcctaccacaagggtatgaaattgcctgtgtcactgtacctttctagtcctgggtatcacagatgctacaatttttaattggtgaaaaatagtatttcaatgtaatttgtaatttatttaataataaggttatacaatgtatctttattgggcatttgtatttctttttttgtgaactgtcttcgtggttttattggatagttttatttttaataatttttataagctctctgtaaaataaagaaattagattttgaattctcctatgcattgcaaatgtctttctagtataagcattttaatgactgtattttacattttatggtgatattatagtttatgtgaatggtgggacttttgttgcttacagtttttcattacaatgctgtcaagagcatccatttattattttctctggaaatttcttagaagtgtaaatggtggatggaagggaatatacatttttaaggcattgattcgtattttctgtctctctagaagaatgataaaagtaggttgaccatcagggtatgtcagggtgcctatttctcaataaccaatgatattacataatattatttttaaaactcttggccaatgtgtatttttttttatgagttagcattgagacattttccatatgtttatttgcagttagtatttcttcctttgtgaattgcctgttcatgccttaagaaggattttgactatatgtgcaatttttaaaattttgtaaaatcagttatctaacagtggaatgaaccttcccaacactgatggtattagagcaaaagatactggaactgttgcaggaaaggaatgaatgtttattaatttactatcataagtcaacctttatacttgttatctcttttactctttctattttaatcttatggataaagaatgagggacttgggtaagccaagtgacttatctctagttccatagttgtaaatggcagaaatcggctacaaacgctcttctgcgtgacttttagcatatgccttccatcccaccaattatagccttctactcctgagccatacagaatcacatcagtagtaagttagctggctgaagcctatggtacatattggcaaaaaaaaaaaaaaaaaaaatttcagaaaatgtttatctagaattattctgtgcatttcagaaacttggtgttcttttatttttatttttctgcaactattttattaagtaccctgatatattagggatgtagaaaacggggggactaggcagagaccttttccttaatagctctgagcttttcctcttccccacccttccaacccttgtcccttttgaaagctttgcttcccacctgccacccagcaggcctcagcactgcagggagtgaaacctctgccagcctcttgtcctttcctcactgttgtgtttcttttcatactctggtacttagaatgtcgctttttctctttctccaatgccatggcaacagtgcatggtaactgcttcccttctggtcaaggaaaaagattttgtatttttttttccctttgacctgtttgtaattagcactgcggtccaccctttcctccagtgaaaagcaaggaaataccaggctgtagtcaagactgcaggacctgctggatgtatagctagcaggtcttctgtgctcctttgcagcagtttaaacccaagcccagcctgatcattgattctgaaacagcactcaaccctccacccctgttcccctgccccttcactgttttttgttttttttttttgacttgatgtgttatattggaggttggttccttcagtctccctgcactagaatgtagggtccaggggagtggggtttccttttgcttgttgctctgtgtgttccctgggactagcgcgtagtggggctccctgagttcttgccgaatggcacaggatttggtagtggaaagcctgatttcatttcatagaatttgctctccttgcgtctttttctctcttaaaggcagtgtctgcattctatgtggccctccctgggaaatgtcagtttcagaggattttgaagtctatcagatcccagggcctgagccaagtcagagcctagttggagtgcattgtaattgacataaaagatttgcatttgaaataactcagaggttggtttgaatcctgttccccacatgtttttagtcactgtctgagtttgaggaaggctttttgagcctttttctttatctgtaacatgggcataataatgcctaccttggcttgaagtgaagattaactctgacaatctatggagagaactggtacatagaaaaataaatgatggtggtaatatggttattagtattttcgttttcttctgtgtgattttctattggtaaatggagttattttatcatttgtattgtaggctactcaatggttaaaagctagattgggtggctttggagtgtgatggtctgggatcctgtcctgctacttaacagcaatgtgacactgtgcaagagcaggcctccatttgtaaagaacagtaaatggtcataatagcagtatcgacctcagaatggacagaaagatttgatcagcacaaagtttggttcatagtaagtccttagtaactcatattctatagtttaataataacagcagaatgaaagaagcttaaacttcatctagtccaactctaatactcccacttcatgtctaattctgccatctagagcaatagagatccaattggtatccttttcagatatggcctttcatatacttaggattgagtcctgttatgaactgacttgtatctccctaaaattcacatgttcaagttctaacccatagtgtgctgactgtatttggaggtagggcatttgaggaggtagttaaggttaaatggggtcataaggatgggcccctaatccagtaggactggtgttcttccaagaagaggaagagacaccagagtgtatacacacaggaaagaccatctgaggacaagagcaagaaggtggctgtctccaagccagtaagagggccgccaccagaatccaacccagatggcaccatgctcttggacttccagccttcagaactttgagaaaaatgtctgttgcttaagccactcagtcttctgtcttgttatagcagcctaagcagacaaatctagatcccttttcttttcttatgtcatcatccccatcttgagggggttttcagttgcctcttcatcattgtcacccttgtctcaatactttcacgtgtcagtgttcttttcaaaatgggaaacctggagatgaactcagaacccccagatggtccaagcattttgggtgccggacactgcccttacagtggaatcgcagattgtgtgaggtagtccatcgaataaacccccaagactcaggtctacattatcctatattgggtctgttatttttgtccaaattcgaagttttgtcttgttaatttcagcttttatttgtttcagaatctagaaaatcatttttttaaaacctcgttggacaggacctttgaagggtggcccagccagcctacctacttgcccagtgatgctttccatgctgtgtgtcttagtttgagctgctgtagcaaattatcatacacagcgtagcttaaacaacaaacatttgtgtctcacagtcctggaggctggaagtttgagattagaatccttggtgagtgtcctctttctggtttacatgtgtccttacatggtgtaaacagagttacctagttttctggcctatttttatgaaggcactgatcccattgatgagggctccacccttatgacctaattaccttatgaagaccctacctccagataccatcatactgggattagggttttaatgtatgaatttggggggaacacattcagcacattgctctcttcctagcagtggctgcctccattggtggaggtactgttttgttgtgaaacttgttccggggttggattccttcaaatgttcccaggaattagctatgttgagtcaaaatctgaccctgtgataactgctgctctttgatcacatctgtctgtttgttattcctgcacctggcagtctcttacagactccctgctcccctcctgttacctgttctgaacattataacagcgttgtatttagtatcattgcagaaaatcaattccatttgcttttcacaagtggaaattagacaaatggatctggaagtacataaataaagtaggagcctagttgacagaaggacactctatttggtttgttttaatgaatagctttcatcagatcatactctatgaaaatagattgaggaaataggctattcattccttattatttgaattagtaagagtcatacctttcttttctgtttaggatgataggcattaaatcttcatctgactctttatagtattttgtttatttttattttttttgacagtcttgctgtgttgtccaggctggtgtgctgtggcgtgatctcggctcactgcaacctctgcctcccaggctcaagcgattctcctacctcagcctcctgaggagctgggattataggcacccgccaccatgcccagctaatttttatatttttagtagaggcggggtttcactgtgttggccaggccgatcttgaactcctgacctcaagtgatccacctgccttggcctcccaaagtgctgagattacaggtgtgagccactgcacctggcctgtttatagtattttagaacaggaagggaccctccgaatcctattttccacatccctccatggcagaattatctttttatgtgccaggtccccttcctttttgagggactcaaaggcagatgtgaggcgggactcaaactccttgtgctgaagcccgggggctgcagcctcattcccctacctctggccatcagattgggcctgtgatctgagcacaatcagccccacccattctggtattttctcaggagagtggttctgtttgtgaagactcttggggccagctaggccagttgatggggtattgtcctcatgacagtattcagggtccagagcccaggcgcatgggaggggactgtccactgaggggaggccgtggtggctgcagtgactcggtcagcctgtggtgtggcaggaccttggctgagctttgccctgcttgttcccgcctgagcctgggtgtccggccctcccagagacagggagcttccccaaaccttgccagtaaacacacaccttttctacctaaactaacttgagtccattttgtttttaatttgtaatctacataggaaggtccttatttgactgttttaaacttgtggcctaggattctggggttttttcattcctgcctaagcacatgtgaggtctgcatggtctcattaaggaatgcattccctggggtggataattgctatttatgtggcagttaggaattttttgtctttttttttttttcttgagacagagtctcgctcttttacttagggtggagtgcagtggtgtgatctcggctcactgtaacctccgcctcctgggttctagtgattctcctgtctcagcctcccaagtagttgggactacagcctcccaagtagttggtactacaggtgcacaccgccacgcccagctaatttctgtatttttagtagagacagggtttcaccatgttggtcaggctggtctcgaagtcctaacctcatatgttcctcccaccttcacctcccaaagtgctgggattataggcacgaaccaccgcatccagacctctcatctttaactgattgattttcagaggacaattctaggaaagactaaatgttttcaccttttcaaaacaggtgctgttaagagaaggaagatggacggggagcatgccaggatgttggcatttaggacatgggaagttgtataaaggtgaaactatgtctgattgtctggtagaaaaattacagtctaattagaaatgctgaagtttttccagacctttagggaattcatcgaattgcaaataaaagaaaataaggaatgttggtttgccggtaattagatatattgggggaaatgaggttgtttcttttcttttctttgttttttttttttttttttttttttgaggcagagtcttgctctgtcgcccaggctggagtgcagtggtgcgatctcggctcactgcaagctccgcctcccgggttcatgccattctcctgcctcagcctcctgagtagctgggactacaggtgcccgccaccacgcccggctaattttttgtatttttagtagagatggggtttcaccgtgttagccaggatggtctcgatctcctgacctcgtgatccgcccaacttggcctcccaaagtgctgggattacaggtgtgagcccgcacctggccgaggttgtttcttgtttttccttttacctagcgtttctttctttcttcaaaaaactagatagtgtttattaattttactgtgcaagcaggaatatacataaacttttaaaattcttaaagctataggtattttgcgcactgttttaaaaaatcccttgtggggagatttttttttaaatatttatatggagaacatgtatctgttgtgtctacagacccataatgatggaactattatttcctcctaaatatttgctcctcgtgactagaatttttggactttgaaagatccttgggtttactttaacttacaggtatgtttacaggaattcaggtctgtggagtaagatagccaaggctaatagttatgaaacatcccatatagtaatttgaatactgaatttacctaaagatgaacattcaaaagatcaagggcatttcattaatgtagtcttaaattattttgctaaacaaagaaggtatatgacctctctttagaaatggccactaataaaaagttgttggtataacataatttttttaacaaggcctaaaacatgcatacattgtctgtcattacagagtcccctgtcacccagaacttttctggttattaacacaaatttatggtgtaccgttgatttctatgcaattgaacgtgaagctaatgttatagtcattttattgctggctgctgttgcatcgaaatttagatgtcttattttcaggtttgaattaagacaatatgtgctttgtaggacactttgtcaacgaatatttgtgggagagggatttttaagagaatgtatggttatgatgtgactgcttcgcactttacagctgttattaaagtagattccagtaaggtaagtcattctggaaggcatttctgaatattacctccttcccctcaagaaatgtttattaagttaatatgttttatgttgtaatttaaagatttaaaagaatattttccttttcatagtagacactttggaaggctatatacttatttctgtgatgttataataactcaatacatgctactaaatcttttttctttggaattgtcttcatatcccccactgcattttaaaaacgtatccccagtggtgttgggcctttatatttttgtgggtggagtttttttttttttttttttttttggagacattttttttttgctctgtcacgcaggctgcagtgcagtggcgcgatctcggctcactgcaacctccacctcctgggttcaagcgattcttctgcctcagcctcctgagtagctgggattacaggcacatgccaccacacccagctaattttttgtatttttattagagacggggtttcaccatgttggtcaggctggtctcaaactcctgacctcgtgatctgcctgcctcggtctcccaaagtgctgggattacaggcgtgagccaccacacctggcccaggccacaacattttaaagtatgctctgcaagctaggtgacagcaagctgggaaatagtttttctttagtcttgagatgtctataaagaagcgtgcatcgtgtgatgtgaaaactggcgtcgaaggttctttcagaataggaattccaaatgatttgctcaggattccttgaaataacgtgtgtggttttctaaggtgaccatttgaacgaggacaattgatttagatatacacattctgcttttaaaataaagtttaaagtcttcttgaaaagtttatggtctcctgtaaactttgcctcagtgtcagagaatcctgatgagtcagaattggacttgcagggaggttttctgagttggagaatctcagatgttgggtagaaacataaggttttcttaattgaagccagtggctgccctgaagtggtgcacagttttgtgtgcgtgtgcagaatttccttctctggcaatttcaggaactatagaaatgtggacataaatttctgtttataaatctggagccaccgtgaggagcttgagatgaatgtctgctgtggtcagagtgctcagtgagttcctcaaagcagttaccagtctggttttggtggtttaggtttggatcttttgctagccttttgtagaacttggatattggaagcaattctcctcgcagctcccaggaatatgtgaatgggccctcgatacccaattctaattctgagcacttggaaaaagtctgtgttgggagaagcctgtatcttccgtcacctgattttcctgataacctgtgtgtatctttcacatgcctccatttctggttaccaactttatcatgtgactcttttggcagctagtagatatttttagtaaatataaaggaattcctcctaccaacatctgaggtcatttgcctttccttgattttctaattttctggttgaaatagtaaagagaaccctaccctgatggtcaaaggttctaagatgttttgtggaccagctcataaaggccttcagcagggcaagtctggtatctgctgggctttctggaaatagttaagtgagtcaataggtagctttgatgttgtcaggtttaatatggaaatagcattttactactagtaatcttaagattttttaatagaaaatcctggccaggcgcggtggctcacgcctgtaatcccagcactttgggagtggatcaccttagatcgggagtttgagaccagcctgaccagcatggagaagccccgtctctactaaaaatacaaaattagccgggcatggtggtgcacacctgtaatcccagctattcgggaggcagaagcgggagaatcacttgaacctgggaggcaggggttgccgtgagccaagatcatgccattgcactccagcctgggcaacgagagtgaaactccgtctcaaaaaaaaaaaataaataaagaaaaaagaaaatcctaagtgggattccatgctgataggtcttacagcccacgtgaaaagaaagccaagtaaaagcttttatggcaggaaatgttcctgtctgcctggaatggtttggaccaggcaagcagattggaattgtttttcctcttaagttgctttgttctgtttttggacatgttttccctgaactacacttaatagcaaagtgcacctaccatcccttctccccctacccaagccttgcttgtgagtatctcctaaagcagcatgcttttaggtatcatttattttaagactaatttgaaaattttatgccaattttgcatttcatttaaaaatatatttaaatatcaaaatcagattttaaatgaccatctattcaaattgagccccaagaagatgtgcccgttggtccggaaacgttgcgtcctcctggggcacactggtttgtgaccctggggatctgaggagtcccctgtttgagaagaacagttgtagggcataactggaagccaggaggtctagggaagtatttttaaaaatgactctatttgtgttttttggtttttttttttttttttaagacagtctctctctgttgcccaggccggagttcagtggtgcaatctcagctcactgcaacctccacctcccaggttcaagtaattctcctacctcagccttgcgagtagttgggattacaggcgtgcaccaccacacccagctaatttttgtatttttagtagagatggggatttcgcagtgttggccaggctgttcttgaactgctgacctcaagtgattcacctgcctcggcctcccaaagtgctggaattacaggcctgagccaccgcacctggcctgaaaaatgactctgtttgacagcctagtataggtgtggaaactctgtgagaagtggaatggcagtccacctggaatgtatgtggtatacagctgcttaattaagaaatccatcttagtgagcagcattttctttcaaatagcctggtatagtcaactctttactgagattcaagtcgactgttttctctgactgagtgctagctgtaatcctgggaaaagttatacagcacattggtgatttgttttttccatcttatatgggagattaaaatatttgttgcctactcccctcatcaggtgttgtgaggattaatgagatcattttagtaatgtgccttaaactcacaagaggaaatgggcacggaaaagcccaaaccccgggtgttatattaccaggagcttaactcaggcctggcatttacgctgctgttatgtgtccatttattttgttcacgtgttgcttttcgcattacaattctgtattaagcttcagatccatctcatgggtgtgaaaatatccacgtgtcaaaatcaagagtgggcctgttggcttcacatgttttcacttgccatccatctccagaatcttgcaagcttgacctacagcttgttggattggacactttttatgtacaccacttactgcattttgcagcttcgagtctatctgtggggactcagctttttcaataactctaggctgtaatttttgagagcattgtttaaaccttgtgctctacttgagtagtaaatggtcacagtggcaaccgggcatgggtcctttctcactagcgtgtgtgatgcttgctgtcactgtcacccccgccgaacggggtaatgggatgagagaacaaggccttaccagcacagcctgtgaatggctccatagaggggacgctggttcctcaagggcgcaacctattcccttgatttcagctggaggaacttctcttgggccttggcatgatgtgctcatacatctttaggtagccaaaacctgacatataactgagtgtgaaagtcagttgccagcatcttcagaaggacattatttctgaatgaccagtgaatgaggttattgtcatagaaaacagcaaagtttaaaataatgttgctatttgggatggcagaattggtgggggaggaaatgagatgggagaaatataattttaaactataaaaattccagtgaagtataatgcttaattgttagcatattctaagcaatgagttagccgcatttaaaaatagctttttaacatgaatgaacctttttatgagccgagattcagtgaagaataagttggtcatgcaaatggtgttttaatagtttatattaaatattttagggctgggatttaaacaaataacattttagagctgtaaaagcaaaaagtctgacctgaaggccacacaaataattatagttcctgaaatatagccctgtgaacaaatctatgccaccttgtttataatctacttcctttgagtttcaaaataagtaaaagggtggcttggatgtaaaaaggaggccactggctttgagcgagttgagagcagtggtagacgcaggatcttttgtgcctctctggggaaaattaggcagttcggaaccactcaggacattccagcagctttggagatcaaggaaggcctctccataaagaagtcaagagtagctggttgttcatgagaccacactttaaggagataatcattgcctctcttgtgaattggttctgaggcaacacaatctttgaagtaaaaaaaaaaaatgctccaggttttaaggagtaaagcattagttttgtgcaaaaaaaagtcattaaggttattagttttgtgtaacaagagttattaatggccaggcaatgtagctcacacctgtaatcccagcactttgggaggcctaggtgggaggatcactcgagcccatgagtttgagaccagtttgggcaacatagtgagactccacctctacaaaaaaaagttaaaacaattagccaggcatggtggcacatgtagtcccagctactgggatggctgaggtgggaggtcacatgagtctgggaactccaggctgcattgagccatgatcacaccattgtgctctagacttggttacagagcaacactctcaaaaacagaaacaaacaaacaaaaaaaacccgagttattcattagatttagagaatggtgtttcttgtaactcttactttaattgaggtattttgcctataaatataggcaagtatatgtagaaactatgcatgtgtgcgctgtcttcttactaagacattatttcttctcttcgtgaagaaagcctgcctactggggctaaattacctgaaacaaacaccatcattcacagagagacagtaagtaagcaagataagcatagaatatgtagggtaaatgacccatctgatctgtttgggcaagcattatacctctcactcttttcaatgacatatttgcttcatgtttcgataatgtggtgtctatattttaactatgaacaaagtcttaaaatattgctatttcattaaatttggagtactgttaataaattatttatacctgaaacattgctgttggccattcattctctccccccatttcttattttctcccagctagcgttgtatagcagaaattcttgtgcaagacaaatgtaaggaactaatcagtgattctaatttttaaacactgtggtggtctctgcttacccctctgaatcggtttgagagaagaaaattggatttgtcttgttgatgctttgcaatttagttggcgagtcgagtatgtataaaataagaaaaaaagagaaaatgctaagattcttgagtgggaatccatagtccacagaaacgtcagaggctctggtatttgcatgagaaaagttttgaaggaaatttttagtttagaaacacaaattcaggaagtcaaattctgtggtttttagtaaatggaaatatatatggtgatatggtttggctctgtgtccccacccaaatctcatcttgaattgtatgcccataattcccatgtgttgtaggagggacctggtgggagatcattgaatcatgggggcggttcccccatactgttgtcatagtagtgaataagtctcacaagacctgatggttttatcaggggtttccacttttgcatcttcctcattttctcttgccgctgccatgtaagaagtgcctttcgcctcccaccatgattctgagacctccccagccatgtggaactttaagtccaattaaacctctttttatccccagtctcaggtatgtctttatcagcagcgtgaaaacggactaatacatatgttgtgtaggctgaaagaactcttccaaggaccatggcatatcttggttccaccaatggcctgacgtgacctttaacctttctgtgtctccttatctgcaagataggagtgacaagagaacctagatcttcaggtggttgtaaagattagtgtggcaagataaagttgttagcccattgcctggctcatagtatatagtcatgcatgactttctttttttaagaaaaaagatttaaaacaacaaaagctctctaggcagagttaattcttcacagtgggaggaggtatttaaacttctgggcaggatgctgtggagggaattagagcttgatagtgaattggaataactctaacccattctcaacctaacactgatctttttactttgtaaaaaaaggcatttcactggagctgcattagcaatatagtttgccattttttttccaaaatattatctcctcctcccaccaaaaataccttttgctgtgtgtgtgtgttgtcatatattcccaactttaatgaaagccaaagatttctaagttttttaatgttgaggaaatttttaaaggcaattcgtggtatttacaacaagctattaaatttatttcatcaattattttccttttcttctctgttgataactttagtctacaacaagattttaagaattgcaatggacctatctttcttttttttttggagatggagtctcgctcttgtcacccatgctgtagtgcagtggcaccatcttggctcactgcaacctccgcctcccagattcgagagattctcctgcctcagcctcccaagtagctgggattacaggtgcccgccaccaggcccggctaatttttgtatttttagttgagatgggattttaccatgttggccaggctggtcacaaacacctgacctcaagtgatccgcatgcctcggtctcccaaagtgctgggattcattatttttaaatataaaatttttgcaaagtgaaagccgatgtcatagattttacatggttttcgcaggaaagcaagccatcaattaatgatgtcctttatgggctggagggagtgagtgctatgtagtggaggaagcacacatacttttggccaggatttaggaatagttttgttaggcggtatatctgatttatcatgttcttgactcaggacaaataaaatatctttatggtaatcttaaatacctctttagaggaatatttatatctacaaataccttctgcatttatttatttgaggcagagtctcgctctgtcacccaggctggagtgcagtagcgtgatctcggctcgctgcaacctccgcctcctgggttgaagcaattctgcctgcctcagcctcgcgagtagctgggattacaagcatgtgccaccatgcccagctaatttttctattttttagtagagatggggtttcatcatgttggccaggctggtcttgaactcctgaccttagatgatccgcccgccttggcctcccaaagtgctgggattataggcgtgagccaccgcgcccagcctgcatatatttatttttatggctcttctgttatttttgtcctccttgtcttaagtagcttgactagtaaccttctttgtgtactatattgctgtgtcattgtgttagtaactgtggactcgtaagtattgagttgtcaaagtaaaaaagagtgttgtttccaccatcactttattaacaatgattctattaagagttcttcagatttaggtaaaatttctctgttactgaatgtctctgtttttcagtagagtagtaaactgtctagttgcactttttctttcaccagtagtctttttgtttgtttgtttttttggagacagggtctcactctgtcacccaggctggagggcagtgactctgttactcacggctcactgcagcatcgacctccctgggttcatgtagatcctcccacctcagcctcctgagtagctgggaatacaggtgctcagtgccacaacagcctagtttttgtatttttttgtagagatggagttttaccacgttgcccaggctgatctcaaactcctgtgctcaagtgatctgcccccttggcctcttaaagtcctgggattaccgatattagccactgtgcccagcctgtctttaagagtatgattaccccctcagaattaaataaataaataaataaattgctgttttcctccttctagaagcctcattttcagctctttaaattgtcttcgttattcttttcagttaggatctaattgggatctgttggttatacatagaaagtgtaaaaatgacttactacttcccatctgtaacagccctgttgtgtgaacaatgtcactaagcagcagtttactgtcagctggtgatctattgtgacccttagtacatttacgcatttcctaatttcttttcttgatttgtttttattcagttttttgttggacagctttctattattttatggtttctgctttattactctgatattgaggacccttttctaaatcacatctaaataatagttttctttattgccatttctcttgtcttgtgtctgtgtcttgtattctaatcagacatgccatcgattactcatcttcagaagacacttctttggtcatgcgttctctttcttaagattccttcttacctattaaagaccacactctgcattctgacattcataatttttcaaaattcatatagttgagcatcgtctttgttctgagcatgcatctaaatgatgagaattcagagagctagacagggactcggtttttcttgatagagaaactgctatcagtatacgagacattattgtagatgttgaatcaaaacagtgcccaggcattaggttccctaggaattccaaggaatcgataatgggtaatttttctggggatggaatgatttttcaggttggagtgggacttgtactgtgctttgaaaacaaggattgaatattagtgaaggaggtgacatttccctggcctcatgtttccagcctgagggaccacaatgggaaaaagagtggcttatctgattggtgaatttgtaagaaggagatcctcagctcggcactgcagggcctctctgttcagagctggttctgtactacagccttttctgccttgtgttaacagacctggccttgctggcgtggcttgagtttgtctagctgtgccagtgactggctggggaggtctggctaattcttgtcactgatctttagccattttccctagtcagcttttatcagtaataaaagtaatgtcttgattcccagttctcttagtggaatgtgagtgtgggcagaaaggcaaggtgggtggagtcataggcattaaataccgaggacatgaacaccaaggagatgagcaccgttgcttagtgtcgtgagcaatgagagagaaagttggaataggagactggagtcagatgtgcagagctagagtgtgagctttattttgtaggctgaggacccgctgaaggttttaaaatgctgtaaagtgtacagcgggttattttggtagtatgaatccagtagtgctggagaatggattccccagggctttttcagttggaattcatgcatcttctggctttggatgttcggaagggagatggatatgaaacaccctgaaatgatatgtaagatatattaaagggatcgtctttcagaaagggattaagaacctccacttaagctggacgtggtggctcacgcccgtaatcccagcactttgggaggccgagtcgggcgggtcacttgaggtcaggagtttgagaccagcctggccaacgtggtgaaatgccgtctctactaaaaatacaaaaattagctgagcgtgatgatgtgtgcctgtagtcccagatacttgggaggctgaggcagaagaatcacttgaacccaagaggtgcaggttgcagtgagccaagatcacaccgttgcactccaccctgggcaacagaacaagactccgtctcaaaagaaaaaaaaaaaaaacaccacttaactcctctgtatcctgtttgtatataggacttattggaacaaaatttcaccattaagtatgatgtttattctggattttttaaaatagtgctttaagcagatttgtagaagttctttgtatacctagtttgctaaggttatttttaaaataataaattgacattcacatttattgcatataattttatgcatgtattctgctaaccatatgggtttttctttttcatctatcagtgtggtaaattatattgattgagttctaaaattaaaacagcttggcattcttaggataaagccaagttggtcatgatagattatctttttgatgttgaattaactttgctaatatcttaagatttttgcatttaatcttgctagcttgacctgcatttttcattgtaaatgttttctgtaattccttgagtgctcagaaagaatctatgtcctgggaacccaaaagtaaataaatagatattcccccaaaagaaagtaaacaaaaaagggaaatagtaatacatgtgtatgataaataaataaaacaaaagggcaggagctataaaacaaaggcctttctctaacctcagaaacccagttcccctaagacaatctctgttaacagagggtagcctgtgtgtttgtgtgcatacataattatgtagatgatacattatatgcatacattattatatatgtaacagtatatcttggcggtagtttcagtgtagcacacaaggtttttctcattcttttttaatatctaccttatattttattatatttttgtatattagccaggcccttgatgacatttaagttctcatattttgctgaaatgaacatcattgtaccttcctctttggtatgtgtctgtggaataaattattaagagttgagttgctggataaaagggcatatgtgtttcaaattgtggtagcaatagcttaattatcttcgaaaaaggttatacctccttacactctaacagtgtatgagcgtgctgtggcaaatatctgaagtgttctggccaagactcatttcccacagcccaggtcatttgaagtctcagtcatgctagctgcaccacacttcaccccacccacaagtgcattcattattaacttggtgatctcatgagctttggcaagcagtggcttcctgctagagagcctcataagaacctcggaaactgctgtgttctagatgagcaggatctgagaggatgttggcaaaatgcccagacataaggtactgaggccgttctgcctaccttattcctgagtctttttttacagccctccctgtctaggctgtaatggaataggtgaaagaattgtagcaaatgctggccatcttctgtcagcattccaatgctagtgactggagggaacagagatggatgagatgtggaattagctgttgggcccgtggattctgtctagggtgttcttacctttcactgtttgcctgagttgaagtcattgctcacattgtacagtcactgttgtttcctgtgtggttgtttattctttttttttttttttgagacggagtcttgttctgttaccaggctagagtgcagtgacgtgatctccgctcaccataacctccgcctccctggttcaagtgattctcctgcctcagcctcccgagtagctgggactacaggcgcgcgccaccatgcccagctaatttttgtatttttggtagagatggggtttcactgtgttggccaggatggtctcaatctctttgaccttgtgatccgcccaccttggcctcccagagtgttggaattagaggtgaaagccaccatgcccagccgattgtttactcttaaatccaggtgtgttgaggtgatagatgccccaagaattggcagtcactgcttactgaataagtagttaagatttcatcttgggagaggagaagtgatgggggcatgtaactcttggttatccctatgttatttttataaacaggatccccaactggagtcctggttgccaccagaaacagtgagaaagcaacacccaggagccttggggtgtggcctcagctgatgaggtcagaggagattaggggtagggaggccaggaaaagccaaaccatggatcctttgttaattgtcccttctgttattaacaatcatttttaagctagagagggatatatgtaaagcactgaaactttgctaaaatagcctcaaggttgtgtgctatatttaccaaaactgagaaaatattaaagtgacaaaaacaaaacaaaataagtggtcctctaagcaagactcggttggtaatgtatataaagatttttattaatctgattcttttaaggtgattaggtctcccttgctcagaaaccttcatcacacccctttccttaaattgactaccaactaaatatactctaaactcttgagcctgacattggaaactttttagagagaatctgcctctccagtgtaatcatctactttcttatgatttgcagtgaagttcatggaccagcagcatcaccatcacctgggatcttgttagaaatgcagactgtcaggccccaccccagacctgctggatcagaaccagagttttagcgggataccagtgttgtgcatgcccaccccagtttgagaagccctgatctcttatacttcattctcctcagccttccttcatgtgatacaatctgctgaacgggcctagctctcattttctaagcgtgttttacacttctccagtgatctgcctttccttaaatcatacagcttcctcagaaaagtctttttctttcagcttccttcttccttccattcattcagttgattaggggtctaaaatataggccgggcatggtggctcacttctgtaatcccagcactttgggaggctgaggcaggtggatcacctgaggtcaggggttcgagactagcctggccaacatggtgaaactcattgtctactgaaaatacaaaaattagccgaggcagtgtcatgtgcctgtagtcctagcaacttgggatgctgaggctggagaatcacttgaacccgggaggcggaggttgaagtgagccaagttcgcaccactacactccagcctgggcaacagaatgagactccgtcttaaaaataaaataaataaataaataaataaaatatgctaagaacgatgatttggcttgagattcagacatgactgaaaacacagtccctgtccactcctgggacagcctctctggaggacagctcagcaacgtgtatcaagagtattgaatatgcatttcctttgatctcaatgttgtctcctctaggagattttcataaacgaataatcagaaaagaatgtaaagaaatgtgtagaaggttgattgttgcaacactataatagtaaaaaattgataaatgaataattgttatgcataaacttttatatagccaagaaagtaatatatatgtaaccaaaatgaaaatatatcaacattaacaattatattattaaaatagacaaagacaggccctgtggtgtgcctatagtcccagctactcaggaggctgaggagggaggatcccttgagtcctggagttcaaggctgcagtgaactatgatcgtgccactgcattccagcctgggtgacagagtgagaccctgtctctaaaaacacaaaagagacgtcatgtatatcaggtgtctagtgtggtgctgccccttcagatagattccagaatgaaggagatgccgggggaatcttcttcagcctacccacacctggagcagagccacagttggccctcaagcagccacaacatctgagcaagaaataaaccttcactttaagccactaacatttgaaggtgatttgctactgccacaactaatctagtgaaagctgactagcacattgtgtactctgcttatttgactccctcgttgtctgcctgcaccttgatgttatctctttttttggcgtctgtccatcctaacgtgacgtcacttacaaagttgatgcagttcattgaacttgggatgagggtggaaagattaatgttgtaattcccttggattagagcagtgtttctcagtgtgtggtccttgaaccgtctgtatcagaatcctgtggggtttggcagggatacagaatcttgagcccccactgcaggcctgcgaaaacagaatatttggggtgaggtttcaaggaattctcagatatacccaagtttaggaaacactggacttgaagctagacaaatactacatcaggatgttactttgtgcatcccctccaccactgaaattggaatatgatagacagtgtcccttggtattcttctccgaccagaactcttttttgtgatggatggatggatggatggatggatggttgattgcttctagattagggaactaaacattggtcatctttatgagaaaattttagccagatttgattcaagaactacataacacttgacaagtaaaatgaatgagtacctcaactgatatactttttccatactactctttttttttcttataaaaattaaattttagttacataattaattcatgagtacattctcatagaaatttaaagcattactgatgaggtcaaattcagcattgaacccctccccaaatcttgggcccctcatatccactgtgccacaggtatcttggttttttattttttccagatttttttctatgcatgtttatgtgccgtgttaatatttatggctaatacagatggtccttaagatggttcgacttaagatatttttcaacttatgatggggatgtagccacatcataagttgaggagcaagtgtatacattaaatggcctgtaccaatacagctggtatccattctcactgagcaagcatctgctgaaattgctcagagccctgtgtcactgtttgatatcttgagtatcaaccctgcagtttgtacttgtactatgtatgtgtgtgaggagtgtatacatatatatgtatatatgtgtgtcttaagtgtcatactacacatatttttttcagtttgttttttatatatgttggcatacatccatgtcagtatatgcgagtttacctcatgttaaaaaattgctccactgtattccatcctatcgtttatttagccatttcttttcttttcttttcttttttgagatggagtcttgctgtcacccaggctggagtgcagtggtgccatctcaactctctgcagcctctgcctcgtgggttcaagcaattctcctgcctcagcctcccgagtagctgggattacagatgcctgccaccacgcccagctaatttttgtaattttagtagagatggggttttaacatgttggccaggctggtcttgaactcctgacctctggtaatccacccaccttggcctcccaaagtgctgggattacaggcgtgagccaccacacccggcctatttagccatttgtatattgatggacagattgtttctagcttttgctattacaaacagtgctgccattgatatatttatatgtgttgccttgagtatctgttcaaatgtttgtaaaccatatgtatgtacatacacacacacacacacaacatacacacacatatggagagagacagatatatatgaacatgccgcgtcaccattaatttataccccaaccaggagtttatcagtttcctcatagcctttcaaaattgattgtcagtctttttgatcattgccactattgtgggtaaaaactggtgactttgttttaacctgtgtttcactgatcattaggaaggttgaagatcatttaatgtgtattcgccatttgtatttctgtttcttaaatggtctgtttttatcttctgcctgtttttctgctgggttattgatgtgttggagtttgttatatattagatatttaaatatatgttgcagatgtttactcacagttgatacatgtcttttatctttgcttatgttgtcttttatcatttgtttttactgtcagacctgtggtggtcattctcgattttatgtagtacctgctggccatcacctcgtctcctcaataagttgtttggattcttacaagaattagaaaaataactaaatgtctccaaattgtccatatgtaagagcttcgaagggctctcctgaataaagtgtatttaattgcatggacttgtaaacatgtatgctttggccactctgaaaatctgctttctatattccaaatatgtttgctggattattgtgctctaaataatggaactgttattctaacagtcctataatttgtatatttaattcatttgttcttgttcacaagatgatttgttatcagtctctcacagcacaattagggatttgtaatcagagtcacatcagtagtctttgtaaattgatgtaagctgttaaccgcgttgaaccagattttactatcatgtgtatcaataaaatgtataggtgatctctgactttcacatgtgaatcccaaaagtttacttaaaatttaattatttggagctctgttatttttccccagaaacaagtccgtttttaggtctctggcaagctcaaacaagcattcttaaagttaacagtttatcacattatttttatgttccaattatggatgtaaagatagaaagaataagcctataatcttcagaagttctggagatcattgaccgtggagtaggcatgtgggtaggggaggagtaggatgtagacgtctttaaaactatgaaattgaggacacctcttggtgaatcatttattctccagtgttctgtatttaagaacaaaggtgactggcatccacccattattctttagttcatgcattgtctgttgaaaatgcagtatttgtgagactgaatcagtcttatgtagcaaggaacatttcccagttttttgtttgtttgtttgtttgtttttcttttttgagacagagttttgctcttgttgcccaggctggggtgcactggtgtgatctgggctcactgcaacctccgcttcccaggttcaaatgattcttctgcctcaggattacaggcacccaccaccacaccagctaattttttgtatttttagtggaggaggggtttcaccatgtttggcaggttggtctcgaactcctgacctcaggtgatccacctgcctcggcctcccaaagtgctgggattacaggtgtgagccactgtgcctggcccatttcccagtattatattccttgattgtttgggtccaaaagcaacttcatggctaattattttcactaattgcacaaatttgaagccattgataaaagcaactaacaatgttaacatcagttgtaaaataccctcaagaagccagaaatcctaacttgtcagtgcatttttccaggtactttgtggttgtggtttgtgttgtaggaatggtggctgtggccctagaggattgggttttgttccttgctttccactgccctgctgttccgtggtcctttttggtttgttttttgttttcttgagacagggtcttgctctgtcacccaggctgaagtgcggtggtgtgatcatacctcactgtagcctttaattcatggactcaagcgattctccctgctcagccccctgagtagcagggactacaggttacaggcatgtgccaccacacctggctattttttaaattttttgtggagatggtgtctcactatgttgcccaggctggtcttgaactcctgggctcaagcaaccttcccaccacggcctcccaaagtgctgggatcgtaggtatgagccaccatgcccttttctttttgagggctctgttgtatactcatatagttccagaatgaatattcctcaaacatcagcatgcctaagaatcacatggaggagtcaagtcaaaatgcaggttctgcagctccattcctaagaatctgattcaatctagcaatcagcagtttatccacaagcaccccaggtaacccattgcagctcggccctagagcaacagaaatactgtgtctcctgtgttggctttctcaagtgcatgacacaggacagttcttggatcacttgcgtgtgtgggtgaggccgataaactcttgtcaaggcaccagggaacaacctgatgttccccgagaggtcagtgaccaaatgggtcgtggaattttatattatgtatatataaatatatgaattataaattgataagttatagttgtatatatttatggggtacaaagtgatgttatgaagtgaaaaggaaataagctgggcataaaagggcaaatactgcatgttctcacttgtatgtgggctctaaaacagttgaactgatagaaacagaaagcggaatagtggttaccagaggctggggtaggggaaatcgggagatgatggccagagggtgcaaagcctcagttggacaagaggaatacgttgtttctttttgcttgtttgtttcttttttgagctctattgcagagcaccttgaatataattttaataatggtgtattatacatttcaaaatcactgagagtaaatttcaaatgttgctaccacaaaatacaaaaagtatttgaggtgatggatgtgttaagggaaaagtaacagagttcctcaaaaaaactaataaaataaccacttttaatatgcttctgtaaacaattcctttctgagaagtttattccttttggctttcaacgaatagtttgtgtctttgaatattcattacaaataaatagtttgtttctttataaaagttaaaaaggtataatgggaactttttcatattgcaggtagtatgagtatcgtgacaaagctatagtttaaataggtgctattgggcacctattgactgccctcagaacctccctgaagctgggatgtaagaatttcgcagtggaaagtcaggcagttgatgcatcttgtcttgtcatgacattttgaagaatgactttactggtaattgacaggagtattaagcacccatataatgtattttacttttctatatcattttaaattaaaatttaaaatatgatgaaaaaatttatcaagacgagagatagtgttattcgtctgagaactgatgtgaaattttttgctaaatttatattttcaggaccttatgctctctttggtgcccctctttaccttgtccttacagacatgtgttttgtagatgctctgagctcagtttatggacagttcttcataatattcatttattaacagccagggatgaaatgcttggtatgatctggtcacgatttatgtcctatacacagaaccaaaagctttccactgagtgacctgacttcagattttctttgtgatatgaagctcatgatcatttgcttggagatatttacctttaatgaaatttaagtgggacatgtatttcttacagaaattaatgcaatgattatattattttaaatatttcgtgtgttattttagtgtaaatcacaacatggatttcatgagtttcagaatgtttatatttgcctaggagattattttttttctgcatgcatgtaggttgggtaaatgattaatactgtgtaagtagaaaataacattgatttaatttgtttgatcactggtttaactccttggaagagaagaaaactataaatatatatatatatatatatatatatatatatattttttttttttttttttttttttgagacagagtctcgatctgtagcccaggctggagtgcagtggcacaatctcggctcactgcaagctctgtctcctgggttcacgccattctcctgcctcagcctcccgagtagctgggactacaggggcccgccaccacgcccggctaattttttgtatttttagtagagacggggtttcaccgtgtataactatattcttatcttaatcaagagcaatcttttgcctgtcttatttgtaaggtgcagttctaggtattacatgtttcacttaaatacacagttgccaccaagaggtcacttttaagttaagggaactagagatatagcaaactaaggtgagaagacacttacttctcatgattcccaccttaaaatcacatttagcacctgtttttctctttgtcaaagtgacaaattatgttttttaaaaatatagagtggatttcactttgtttcagaagttattggaacttctgaaatgaccaaagataccatgatatttgcaaagcagatttaggtgactaaggctgatgcttatgcaatttctttgtaggacttcttcctaaccttttccaaggtttcaaggcttttttgaggtttcctagtttataaggattcaggaaaaatatttattgaacacttcgtgtgagcctgtagtctctgctttgcatagtacttgttttgattgttctcagtacctgacccacctccatttttttgagaaagaagtagaggagcatttatgaatgttatttattcagtctggttgatttcctcatagggatcctgattatgctgggctgacttttaaagttctgtgtagttttcagcttttcctcatgtgacccgacttaaatccccaagtgctctcccaacgtggagagctccatcctcctgttaagaatccagagtctgtagccagtaagatgtgttcaaaggtttaacaatgtttttattttttaaatgcaaatatttatactatctgcttcatttgtgaattttaaacattatcagaagcacacaggtccagaacctgaggaaggcaaaaaaggtcaggaataggtaggggaaaaggcgagatgaagtcttgaatcactaggtttattgtttgctgtccaagtccgcccgtcttctcagtctgtcattactgattatgagatggtggcaaaggcggaggatatgctgtgaactcataatagtcggttgttaattttcttcaaattctttcattgaaggtctccagctctttagttactgctgtgttagtgaaggagttgtgaagaagacttgatccctctatcctactttagttttatgggaggctttattacaaatgaatgtgtaccgtcctagctttctagctcccagctttctatgtcacacttcaaaaaaaataaagcagctaccaccattggtaagaagccctcgggtattatgaattcagaaccttgcccaggccaggcacggttcctagaagggggatagaatcttcccatctggttaaaagacaacgaaaatgggtccaacatgaaggttaccaaaggaagattcatttgaacctgttaaaggcatgctttcttgtcctttcctctgccttcacatgtgtgtcgatggaagccagctcgtgccactgcggctctgctctgggccccccgccaccccatatggccgccgctccctgaccccttgcctggaggagcagcagaaccccggcttccccttgtcccaggggagcgtctttcacactggaaatggacagagtgaagagagcagctggtgggaaaatgagaatggacctccaggggcttttaacaaggccatgaattcagttattggtcttgtgctcacacaattaaaaacaagctggcagcggggctgcatgatgactgggtgaggaccgaggcttgctttttgccgacgtcttctccctaagctggtggtccatttcctgctttgccctttggtttccatgctgtttctaaccttcacaaattaaagatggggcctttcagctacctggtttgtttcctggctgttttgtccgtgaagctctctactcttgagaggcattctgtcccagttttacttttttacttgatgttgttactgacttttggaatatctatccagttagtctgtgaggggacgagggactggttgtagggcatacgtgagccatcccctttggcccaagcacgagcatcttccccatttgtttatgtgcaggtgtatgtcaaatatatatttatattttattatttaattttattttataatatattttatttattttattttatttatttttattttttgagatggagtcttgctctgttgcgcaggctggagtgcagtggcacaatctcagctcactgcaaccttcgtctcccaggttcaagcaattctcctgtcccaacctcccaagtatctgggattaccggcactccccccagcacctagctaacttttgtattttttttttagtagagatggggtttcaccatattggtcaggcttgtcttgaactcctgacctcaggtgatccacccacctcggcctcccaaaatgctaggattacaggcgtgagccaccgtgcctggaaaattttatttattttattatttaatgttattatttgttgaaacaaggtgttgttccatgcccaggctggagtgcagtggcacaatcatagctcactacagcctcaaccttctggactcaagtgattctcctccctcacgctcctgagtagtagggactatgggtgcatgacactctgcctggctgatttttttattttttatttttttggacaggggtctggctgtattgcacaggctagtctccaactcctggcctcaggcaatcctctcagtttgacctcccaaaccattgagattacagcatgagccaccgcacctggcctcaaatatatttttaaaggaaaaaaatgctacacatgctaggacttgaatcttcctctttattgccagataaactgagggaatggatagttttctttgtttttcagcaataaaaaatttttaattatagtggaaagtcttaattatagagggagagcaaagtgtatttggatgatctgtgctaaaaaggaacagtacaggtggagtaacaagttacatgttagtcttgtgattatctcattaatgactcatttgtacttgaaagcagcataaatacatttatggaaaaatatgaatgtgaacttatttattaattttttttggagatggagtctcactctttcgcccaggctggagtgcatggcgcgatctcggctcacggcagcctccacttcccgggttcaagcgattctcctgtctcagcctcctgagagctgggattacaagtgtgcaccactgcacctggctaatttttgtatttttgtagagatggggtttcaccatgttgaccaggctggtctcaaactcctgacctcaagtaatccgcccacctgggcctcccaaagtgctgggattacaggtgtgagccaccacgcccagctgacttatggttttttattagataaggtagatgtagagataatgtagatataaagtgtgtatttgtgtatatttctgtttatctgtattggtttcctatagctgctggaagaaagtatcacaaacttggtggcttaaagcaacagagatttattctcttcaagttttggagactagaagtcggaaaggagtcttaggggctaaaatcaaggtgccagaggataatctgtttctttgccatttctagactctagagctacatttcttgcattccttggctcacagccccttcctccatcttcaaagccagtgttgtagtatcttatctctggctctacttttctatgcttctgtctcatgactttcttctcttctgcctcataatctttcttttcttccctcttataaggatacatgtgatgtcatttagggttcacttggctaatccaagatagccctcccatgcccagaaatttaatttaatcacattttcaaaggctatgccatgtaaggtgacattcacaggttccagagattagaatgtagacattttgtgggggaggacctttatttagtctaccacagtgagtgtgaatgtgtgtgtgtacgtatgtgtgtgtgtgtgtgtctgtctgaaattccctagctgacctataagcagctactctccaataacagtaagcacagctagtgttgaggtcttagatctaaagaatatttttcatcgaaaggaaccagttttgttttaaaataaaatggctcattctagggcagatggaaaatataagagaagcatggaacattctgtggcgtgagaaagtaaataaatgctcagagaataatggggacaggtcaaaagacacagaagccaacttgaagaggcttctgtcagtcccaactgggcaatttgagcactgaaataaaaaagcaataaattcagcctgttctgataaaaataaataaaattataaattgaaagtttggtgtgaaacaagatatttacatagttcctaagtgcctttccacagcgtaataattcgttactaagagaaaaagtttaagctgacttaaactttatttatttatttatttatttatttatttatttatttatttatttattttgagatggagtctcactctgtcgcccaggctggagtgcagtggctcaatcttggctcactgcagcctccacctcctgggttcaagtgattctcctcgctcagcctcccaagtagctgggattacaggcatgcaccacaacacctggctaatttttgtatttttattagagatgggggtttcaccatgttggccaggctggtctcaaactcctgacctccggtcatctgcccgccttggcctcccaaagtgctgggattgcaggcgtgagccaccatgcctggctggcttaaactttttaagtcaacttaaaaaggtttctcagtggtgaaacctggcagatcaaagtgaatgtgatctgtaattggacaaagtgaaagcatgtgccactgatagggtgcaaagagaagaacagcctcatgaaacatgaagataagcccaagttgaagaacattctgtaaaataactggcctgaaactttcaaaaccatcatagtcatgaaagttaaggagtataatgtgatatagtagtggggtggtaatagccacgtggaagctctaagcttcactgtaggaggatctggttaagttatttactaatagagtcgtgacttaattttgtaggttttccttcttggtctagctgcattcctcagtgaaaactcttccggtctcctgcttgcatggtgaagtatagggtgccataatttcattagcttggtgagtgaagaaatctaagcatcttaacatccagcatacaaatcccagtttccgctatggtatctttaacttcagtagtgtgtggtgtcccctaggccagagtgctctttgaaaaatctctctagttaataaaactattgttttacctgagtaggggaggggctgtctcccagtgtagtggaggcagggatctgaggacttaagtgcttgataaccattccttgtgaatagtcctctgttatctaagccactcccttttccttcacttcaagagtttaccaggctccctcattcccttgtcctttggatgtcttgtggggtgcattgaattgttcttttccttctccaggttttcctgtggtctcctgtgtcagttatcactagatcatttgcttcaaaaatgtcatttttcttattctatttcctgtgggtttgtgcttttataagaagaatctctttactgtgcttttagtagctttggatgagggcaaatgcaaatgtgtatatttattttgccatcttacccagaaataaacaacagtgattttttaaaactttttctttttcctttttacactggacgtctcccttccccataaacctgttatagaacttgaatctttaaaacagaaatggaactactgtggttgcaaaagtggtgtggggttgagtgaacaagagtctttttcaccatgcctcctttgttgatctttgcagccaccctgtctctatacccaggcagcttctttgaatcttaggattctcatgtacacagctgggaaaaccactggattagagtattatacatcgctgtttttggctagagtgaaagattcacctccttttacaactttgcatgtcttcaaacccacattcctcctgtgtgggctggtgcaaggatataccttctcatccagacccttttgcttattaaaagggaatagcaggggcttgttacctgtcatcctggagaattttccttttgccctctaatctgtagcctttcctaaagtaatagttaactaggctgctgtaataaagtaccataaacagggcactgaaacaacagaaattaattttcttacagttctagagagtagaaattcgagatcaaagttggaagggttgctttcttctgaggcctctctctttgtcttgcagatggccaccttctccctgtgtcttcacatggtcttttctcagtgtgtgcctgtcgtcatcttttcatatgaagacattagtcatgttaagttaggacacactctactgatttcattttaacctaattatctctttaaagaccttatctccaaatacagttacatttgaggtactgggggttaggacttcaacatataaatcttggggggacacaattcagcccataacgcctaactgttgccttttgcagcattagccttgagcttcttgtccctgtctgcacttaagttgtgcgtggctccctgcttccatgggcctggcttctgctgggcaatgggagcagataggattgagcaggatcaagtgcagagtgtgactgttggaaccaagtgttagttttgagtgagtcatgaaatattattttatagtctttaatttagtgtttaattttttctttataatactcactggctgacttggaggctttcagattctctgaaaatcatactgaagttgaaataattaaggaaatgaaggagcatgccacctttctcaaactctactcttaacctttttctccctcctcactcctctagccccatcattcccttcccaaatcaactgaaaaccacttttacttctaaaatttgcctgtagctttctgcttcgtctttttgatttttttacagctaaacaattaattaaaagaatcattctaggctgggtgtggcagctcacacctgttgtaatcccagcactttgggaggccgaggcgggcggatcacctgaggtcaggagtttgagactagcctggccagcatggtgaaaccctgtctctactaaaaatacaaaaattagccaggcatggtgatgcgtgcttgtaatcccagctactctggaggctgaggcaggagaatcacttgaacccgggaggcggaggttgcagtgagccaagattgtaccattgcactccagcctgggtgacagagtgagaatctgtcatctcaaaaaaaaaaaaaaaaaaaaaagtcattctacatcagtagtgcttatcttgtgtctaaaattggtaattataatcggtaatgttgcgagttggataacgtgaatgtaattctttgtaaatgtgaaaagtcatatcaaatgtaaggttgagattttgtttgtcccatccatttaatggtgggcttgcatctttaaatacagggtgtgttttggggatcatgccattgtaattttatcacaaggaaaagatgttactgctcccgtagtgaagtgtctgtgaagctggttcagaagtgtgaagaatcattgtgcttcagaattcaaggagagctgagagataaatttgagtaacactttttatcaatagggaagctgaagcccaaacttgaagcatttgtgtgagactgcgtggtactatcgagccgagatttaagtctgatcacctgaccatcagtccagctgctaatgtttcatgttccatacttcttaaggagatttatgttcgtaaaaacaactgtgatgaagcaaaagaatatattttattcagttagtaatgccaaaggaaatagtagtctgaattctgtgggtctgtcattaatctgattgttttaacaatacagttttcaaagacctgcattaattattggagagatcagtaaaaatttataagccttgctatgggaagaggatgtatcaataggggctcacagcttcaagaataactaattgtttggtaagaataaccccccagtgcaggtggagctgagaaaccaaaggagaaggcagacaggtccagactgttgttatagggtgttttattggggaactgacagacagaagcgtggtttttggcaactgcaagacggatagatctccatgccattataccccagacccagggattatatctagggaaggggcacacatgcttcggagggaataggtaggaatttgatgtaagggcaggatttactgtaagtatgtgccattactcaagaaacagtagataaattggaaatctcagaggcattcccagaactggggttaatcagaagtcaacatggcatgttagtttccaagatagagttactttagcctccacacaaatgcaagcagaatgaattttatattatttagcaaggtggagtatgttaatggagcactttattaagcagagccctttagtgaattttacttctaggtcgagcagtcccttttaaaaaatgtttcacttttgtgatagtctgagcgtactttgaacacggcttcattcggaagctttagcgccttcaagccttgctcctcaaagctggtctgtggatcatggtcaccagggaacttttaggaatgcggagtcccaggccccaccttaacctgctcagtttctgttttaagaagattccaggtgattcgtatatacaacagagtacgaagaccattggtcgagagcagtggttcacaaagaagatggctcctgtaccagcaacatcagcatcacctgaaaaattgttagaaaatgcagattcgcaggccccacagacctacggcatcagaaactctgggatggaccccagcagtacgtgttttacttggtgctgtaggtaatgctaattcatgataaattttgagaaccactctagggtagtatgtttccaacagtttaggtcatgagcaaccttgagaaatacacttttaatcatgactcagcacacacactcacatgcacgtgtgacttagacgttccatgaaacaatgcttatcttacagtgtgttttctgctctggtatttttacttatattctattaaatagatatgtgtgtataaacttattgatataaaaatgtggtcatgatccactaaagtgattttacaagccactaatgggtcataagttgcaatttgagaaacaatagtcttgagcaggctcctcttgatagtctgataaaattctagatcttttgtcagaatagtgcattttaaatgcatacaataatgtagatagagttgcaaaagaaaccaatttgattggctaccaaaatattacatttgtggtatgataatatatgtatcccaacttctcaggaggcttaggcaagaggattgcttgaggtcaagagtttgagtccagtcagagcaacatatctagatcccatctctaaaaaaaaaaaaaaagctatgtttctttattgataacaagatttaatggtgagtctagtaactattatcatttcaaactagggacgagtatacatatttccaaatatctgtagtaactgttagatgatatgaaaatgatgaatttctattgatgacaagttatggttattgctaccaatactctggtttgttgcttacatttgtatttgaaaacatgctaaatttcatctaaaggtaaatgcaaataaatatgtaaatcaccccctccccagcttcatgaacttccagaattctcttgattggcaattgcttccccacggacctgaggttaagaatccttgctcaaggggaaccttgctttagagaacagttctcggccttaaagttgagattctaagcaaaaatttatcttcttggaatttcttgaaacttttgctgtatagatggcatcttttcttattttctagcacccctgtaatggattcctttttaaaaatgttctttctgatgttttagtgagtccttggggcatcacttggaagccccagtgtaggctcttgatactgtttcttctctagtctccccattctcaatacatgcacctggttgttcaagccagattcctgggagtcatccgcaatgccacgagttctagatttggactgctcgggtgtgaatctaggatctatatatctttggaaaagttatttagcctctcattgccttcttttttccacctataagatggggatgacagtagcccccacctcataggattgttctgagcattaaatgagatattccatgtattacattagaacagtgcctggcacagagtaagtggttagtatctattctaattaaccttaatctcccctttccctcttttttttttttttttttgtttgagacggattttcgcttttgtcgcctaggctggagtgcaatagcgccatcgcggttcactgcaacctccacgtcccaggttcaagcgattctcctgccttagcttcctgagtagctgggatcacaggtgcatggctccacgcctggccaatttttgtattttttagtagagacggggttttgccatgttggccaggctggtctcgaactcctgacctcaagtggtgcgcccaccccagcctcccagagtgctaagattaaaggcatgagccactgtgcctggcccctttccctcattctttaaatccagtttatcagaaaactgtgtaattcttcctacaaaatatattttaattcatccacttttgcctattcctccaaacttccctgttctcgtttggatttctagctgatatctctgctgcttcttgtctcactccaattcattttccatataacacccatatgatcttttaaaagtgtaaatgaataatcttttaaaatgcaaatgaatcactgtatcccataaaacgcttcagtggcttcccatcaaacccatcaaaatgctccgtcctttccttgagctacactcttcatcctgcaaatctctaaacttgcccactcacttgctcttctgtggccactttggctttctcttagttatctgagtagcctcatccatccttccattccttaaggccatgcgtatggccttcccgccaatatgtcgctgaccttccccagcctgtcatatttctcatctctgcaggcgttagtttctcagagagctttccctaaccacctgcccaaattagggcaccttacgtggcagccccttggccgagttcctcttttactagcctgaagctccccaaacacttcaaaaaattaatatttcctctctattggggaaaaggataattaacaacctgtgattatcaaacacgtaacaccaagaggagtatgcaccttttttcagaccgatacatttgacgcgttatgaacattaagtgattgtggagctcttttaagaaattgctgtctgaatgttgtgcacgctagctcttggtattaaagaacaaagtggggtctgccccctgaacctgtctccagtggggtgatggaggtgtgattgggtcttcctagtattgtcagtcatttctactccaaagcatagaatagaaatactaacatttccctctttgaaatagttacttcgttgctgttaaaacccttcacgcttctctcccccaaagtgaatggtcagtcactgttcagacatgagaaaagatgatgtctcataaccagtgggtagaaaccagtaccggtgatatctgtatcctggttaatgtttaggttcatagtaaagaggcaaaagaaggcgtccctgactgtgctaggtcaaatttctttgtgtcttgaaatttttttccttgctacttgtttttaattagtcctcagccggagaacagagacactcctgatttttgacagttgcctaaaacagcgaggaaggaggtcttaggagttcagagttaggatgtaccactttcaccatcacctttgtagttcttgtttcaaataagggaatttaggagttacacaggaccctgggacagatgttgaaatgtaggacaatcagtataaatgggatgcctggcagttctgttccatgccctgttcggctgaatggtgttcctgattatataaaaatgtgatctattttggggaaagactggtttttttgttggtgtactttaacagaagccacacaaagaaatattcttgttatggactgtgggtgatgataatcagttggaaaatgatgtgtttaaaaacaaaatacagttttcttttttttttttttgagatggagtctagctctgtcacccaggctggagtgcagtggcacgatcttggctcactgcagcctctgcctccctggttcaagtgattctcttgcctcagcctccagagtagctgagattacaggaaccaccacacctggctaatttttgtatttgtagtagagatggggtttcaccatgtaggtcaggctggtctcgaactcctgacatcgtgatccacctgctttggcctcccaaagtgctgagattacaggtgtgagctaccgcgtccagccaaaatatagttttctaattgcagaaaagttacattaagttaattttttaaaaaccgaccataattcagcctcccaatcaagccatcctttttattttcctctgacttccctatagatgtttatatgtatacattttttatatagctataatcatgcagtgatagtttgtattctgattcttttcatgttacacttttcatgtttcattttgaatggttagatagctttgagtacatatgtcataattattttaccaatctcatgttggataatttgttttatgatgtgttttttaatgatgtattttaaatgtgtctttgttttgttcttattttgcaggcagagacatttgtttgggtgaacaatgcatctgcacattcccagagtgttgccaaggccaaatatgaatttttatttggcagatctgaagggaaagctccagatactagtaagtatttcctcatatccctctcccaggtaaactatatgaagagctgtgatttcaaagtgatttttctccacctgcattactttcttcttccctctgtgaaacctgctttccctaattattcatcaaaacaatcttcccaagatgtagaatccgcaaatatttcatgtaattcttgtggcctattcttggtaatttcaagtcatgttcttggtttgaagaattctcagcttctgatatttgaaattccaagaattaaccagttttcataagagttttccatagttaccattgttatatatattgactaatgtatttttggtggtttttttttttttgagacaaagtcttgctctgtcatccaagctggcatgcagtggcatcatcctagcttactgcagccttgacctccaggctcaaatgatccttctgcctcagcctcccaactagctgggactacaggcatatgccaccacacctgactaattaaaaaaatactttttttcttttttttttttttttaagagacagggtctggctatgctacctaggctggtctcaaactcctggcctcaagccatcctcctgcctcggccccacaaaacactgagtttacagatgtgagccactgtgcccagcccttggtgcttgtttttcactaacaaaatatattattaggaaacatttccacaatgattttcagccactgcagtctttactttggaggttattgtagctcttgtttatttttaatactttttagtattggcctaatctagttatcaaatttagtcttctggaactagaagcaacatttttcactttgaaacaggtaaatttagaacaaatagaactattactagtgctaattacagtaataattaacctactagattacttactgtgtggtgaggcactatgctaatcatcacaatcaccttataagttggtaccgttatccccattttccagatgagggatctgaagtaatcttctcccagtcacaatcactcacacagcagagccaggagtataaggcaagtttgcctgaccgcagagctcatcctgttaatgcaatacttttttgaaggcattttcctagaaggaggtacaagataaaaatgcaaatagctttgtattgaatttcaaaacgtgtaattttatggaaaaccgatgataaaggggatattagcatatcttgagaattagattggaaaaggctattgcatgtggttaatattctctgagttctggatctagacttcttgagtttgaacctggccttgaacttataaactgtgtgaccttgcaaagctatccaacttatttgcggctcagttttctcatctgtaaaatgggattatagtgacttatgtcttagaattattttgagaatgaaataagttgacatttataaagatcttagagtcatgtcccatctctactaaaaaaaaaattagccgggcgcggtggcaggtgcctgtagtcacagctactcgggaggctgaggcaggagaatggcatgaacccgagaggcagagcttgcagtgagccgagatcacgccactgcactccagcctgggcgatagagcgagactccgtctcaaaaaaaaaggatcttagagtcatgcttggtatgtaataagtgctataaaagtgttggctgctgttaattattgtgataaccatcaccatcatcatcatatccctgacctttgaggccgatattataagtgcaatccttaatttttcagctttattattatctgatacttatttttgttttgggaagaccaagaatctgacttaatacatacagctgttgctcagctgaagaaacccaggtatgaactacacatttttgactcacatgttagatgggattatttaataactccagaatatttgaggataccaagaaggcagtgtatacacagccatataataacttcttttagcttaaaaagtgaatatttattagatatcttaatagttggggactcttagatacagtaaaaaaaacagctaaattatttttaaaaatcatttggcttttatcacagtgtcctaatttagaggagaatgtgtttcgtagtatatctcttatacttaacatgtattgtagccatttatgctgtttgtcatgcatcataagtacctaactattctgggcttgaagtttgaggtacctaatcatctgtttactctttccctgacagggtactgattatagttatccccagacttttgaaaactctttggcattggcctggcgtagttgctcacacctctaatcccaacactttgggaggcagaggcggatggatcaccagaggtcaggagtttgagaccagcctggccaacatggtgaaagcctgtctctactaaaaatataaaaattagctggccatggtgacatgtgcctgtaattctagctactcgggaggctgaggcacgagaatcgtttgagcccaggaggcagaagttgcagtgagccgagatcatgccactgcacttcagcctggatgactgagtgagactctgtctcaaaaaataaacaaaaaatttaaaaaataaaactccttggcatagacataactttgaatgtgacactgtgatttttttgctaattaagctttttttttttggctataataaaactgatttttccttaactatatagagataataccaaatgtctacatagttctctgccttatttggtgagtgagtttggttcttccttactcgtgggttttgagtagttttccctgtatcagcagctcagatatatcatagccgaggcaaaccaaaatgacaccttaaaccttttgtttcttatttgccttggtaaaaatggttggtagtagttgctcctggtgtgatgttatgctgtaggtgtgacaggatgcatgcgttgttgaacaaatacatttaatgagcacctttgtgcaggttacttgcgttgggcacattgaaggtgcaaagacgtggaagacatggttcttactcataagtttcttattctttagctaagaagaaacaatatgtctccaagtgactagcaaggaagaatgatcacatttagtttgtctggtgataacttcatggaggaggtggaagttgaacttggtcttgaaggatgactagaattctgaatattagagttttgtggggagagcatttcaaattgcagaaatggtatgagcaggaaatagaaattgtttgacgaactggggaagactagcctggttagtctgcagacatcatcactgagagataagttcagaaagattaccatttagaaaagggccatatcatgtagggcctcctaaggcaagttgaagagtttacagacttttaaaaataagtaggtgaggaaaatgagcttcagaggtattaaagaacatgactaaaggcacatagctgagatgatttagaatccgattaaaaatccagtctctctcatagcccatgagaagtctcagctttagtgcagtcctcttagtaggcacagcatgccagtaattggaagttatttgatgtaatgaggtaagataggtatcttcatgggttattcagttgcgtggagaattgtagaacttcataaattgtcctaaacttgctttttagagtttgtgtgtgtttttgaaactctctgactgtaattacttctcacagctgtctgtgggctggcataaagctgtatcttgttcctcccactttactgaatgcaaagtgctgatggcagctgcagcagagcctgggtcccagcctacgacaggtgcctgtggacaacactgagcctcctcagtttcttcatctgtaaaatagggaaaatggtagtaacttcttcatagagttgtactggaaatcgaatgagattgtaaatacacagctcagggtttggcacgtggtacccaatcagtgtttagctgttaggaaaccgcttatgtattaaagtagcagaatctttatgttggaagaaatagtagaagtcacctttgccttttatagatgtggaaactgaggactcaagagaatgaattaatttgcccaaactcattggtaggtttgagaccatgatccaggctcctctgctctgaatcatgtgtgaaatgtgacatcatctgttcctgtaggaaaaccaactctcagattggaaagacgtaaaagtcacatcaccccactcccttgaaatatgctataaatgtgctgtgttagaaaggcaaccactatcagagtaaacaggctctgagggaggccttcggggactcttctgttggagaaggtacctgatgactaacggaggaaggaggagaactgttttcacattgcctccctgctgccgtcacctgaactgttcagagcccatcattaaaagaaaagagtcgggtggcactagtggggaagccataggaaatgtgttataattttaaggttctagagtgattgtgtagtgagagcttagttgcttggaagcctctgaaagacataccaaaattttgttaaaatgttaattttcttttagttggagctcattctaacttgtattgtctaagcaaattttctctttatgatgatttatggtcataagtatgaataactaaggtgcttgctggacttagatgtgaatggatgctgtagcatatgattttaagaagtgtctcatgtcagttttttaaaaattacctgttttttttttaaaggtaaagtgaatcatatgtagatacatgactccttgcagtataatgtggttcttttcagcaaaattaactagatcagggtttcgcaacagtttgactattgacattgtgtgttggacatccaacaaaagacttgtatgtagaatacatagagagctcttacatctcaatgacaagaaggaaaatcccctaagggaaaaaaaaatgggcaaaagattgtaacagatacttcaccaaagaagatatatggatggcaggtaagcacatgaaaagatgctcaacattattagttattagggaaatggaaatgaaaaccacaatgagatactaataaaatctactagaaaggctaaaattaaaaagactggccatattgtgattggtaagaaagtggagctactgagctcgtacacactggtggcaggaatgtaaaaggtccaattatttaaaaacagttgaaggccaggcgcagtggctcatgcctgtaatcccagcactttgggaggccaagtcgggcagatcacgagatcaagagatggagaccatcctggccaacatggtgaaaccccgtctctactaaaaataaaaaaaatagctaggtgtggttgcacatgcctgtcatcgcagctactcaggaagctgaggcaggagaatcggttgaagccgggaggtgggggttgcagtgagctgagatcgcaccactgtactctagcctggcaacagagcgagactccatctcaaaaaaaaaaaaaaaaaaattgaaaaagttagttaagaagttaaagatatacgttctgtaccactaggccattccatttcttgatacttacccaggatacccaagcgtatgccaatgtaaagacttgtacgtgaaagttcatggcctgtcctccggtttcactgtttgggaaattaagcagattaggaattaggtaactgaatgaggaatgaataacacaagtggtagactttgcagtgtgcgtttcaaaatatttaatcccttcttttgccttaattggctttgatttagtatgcagtatgcactggagtctcttaaatgaaaagacctttgagatctcacctgtgggtaattggctctatctctatggacagctttcagggctctcttgacccctacccactcacgtttctggaagtgtgagtcttgtgttcttgctgtatggtgcctgtggagccctttcagtcatgtctttccttagctctgaaaatatttgtcctctctactttttaaaaatggtttttacttctgcagttcctattagataggtgttggttctcctggattagatcaatcttctatgtcttttaatttttctttcctattttaaagtacgatcttccactctttctaacaacatttttatagttttatttatagtttcaagagttctttcccattctctggtcactcaattttcattgcagtctgcttttttatggatgcattattttgaatctctctaaataaacaattagattttttttccccctgagattatcttctgtttcctggatttttgcttcatcgagggtcagttgtttcattaaatcttagaacttcttttgaaagccaccgttagtcctcaaatgtctgttggagtttgtttttttcattcatatgcatgaatgaaagtttgggttcccagatatagacaggtggagttgctctggctgtgtggagtgtgtgtccttagcaggcctcttcccttcatatagaagagggctggaatgggtttctacgaggtggggtgtatggactggcacaagtgcaggtgggattagacccatgctaactgccttgctgcaggcaagcctctgggttggggaacagggtgggagggggctaggatgggaagctgttctgcagatgatttttcagttaatcatggtgacatatgttctgcttcccattccagatctggagacctgccaactctgggtttctagcttctctgtggctctactgttaggataactgtggccctctgggcttgtttggggttgtgacttctgtctatggttattttgtctatggttatactctttttttttttagcactgttgtgaatttattttcttttgaaattggttgttgccattttcatatgacttagagaagattaaacaaatctgtatccttgtctgccatagtgacccagaaggctgaatactttaaaaaataactttattgagatacaatttgtaaaccatacaattcatccatttaatgtgtaaaattcagtggatttttagtacgttcatagaattgtgcatcatccatcaccacaggccactttagaacattttcatcatcttaaaaacaaaagacttgttggtggctccttcctgtagttccagctgcttgggaggctggaggtgggaggactgtttgagcccaggagttcaagtccagtctgggcaacatagtgagaccttgtcttgagcaagaggaagaggaaaggagaggaaaggataaaaggcagaagagaggagaggaagggagagagagagagaaagagaaagaaggaaggaaggaaacaaagaaagaaacaaggaaggaaggaaagaaagaaagaaacaaggaaggaaggaaagaaaaagagaaagataaaaagaaaaaaaggaaggaaggaagaaagagagagagaacacccactgactgtcattctaggcaaccactaatttgctttttatctctagagattttcttattctggacacttcatataaatggaatcattgttatgactagttttgctgtaaaatttaccactacttttttgtgtggaataatagtcgattatatggatggtacacattttatctgttcaccatttgagggaaatttaatacattagtctgttctcacgctgctaataaagacacacctgagactgggtaatttataaaggaaagaggtttaatggactcacagttccacatggctggagaggcctcacaatcatggtggaagacgaaggaagagcaaagggatgtcttacatggcagctggcaagagggagcttgtgcagagaaattcccatttataaaaccatcagatctcatgagacttatttgctatcatgagaacagtatgggggaaactgcccgcatgattccattatctccacctggcgccgcccttgacacgtggggattattacaattccaggtgagatttgggtggagacacagccaaaccatacatttgggttgcttttcctttttggcttgtgtgagtaatgctgttaggagaactgttgtacaagtttttgagtggatgtaggttttcatttcttttgggtatacagctagaagtagaattgccgagttgaatggcaattctacattaaaccttttgaggaacttctaaattgttttccacaacagttgtacaattttatattcccaccagtagtgtatgagggtgtgatattgtgaaatatgtatttggtttttgtccccatttcctggcatacacctcctaaaatccttagaatgtccgcaatgatgtcttcttgtgtgctcatatgttgactgatggctgtcagcccctaggtagcttcaggacggggctgggcaccagaaggacacagcgggattggagggttcggactttctcctacgtgtgttcagggaaactaagtagcatggcagcagcccagagcccccgggtcagtggctacacagcagcagtgagcagcctcctgggaggagcgaagggctgaaggttaagttggccaatgatttagtcattccttcctgtgtgatgaagcctccataaaaacaccaaaggggtgggcgtggtggttcatccctgtcttcccagtactttgggaggctgaggagggtggatcacgaggtcaggagctcgagaccaacttgaccaacgtgatgaaaccctgtctctcctaagaatgcaaaaattagccaggcatggtggcgtgaacctgtaatcccagctactcgggaggctgaggcaggagaattgcttgaaccctggaggcagaggttgcaatgagccaaggttgcgcccttgcaccccagcctgggcaacagagtgacactctgtctcagaaaaaacaaaacaaaaaaacccgaaaggacagcgtttgagaggttttgggtagctgaacacatggaggttctggaaggtggcgtgcctggggagggcttggaagttccgtgccccttttcccatacataccatatgcatctcttcagcgtcctttgtaataccctttataataagccagtaaatgtaagtaaatgtttccctgagttctgtgaggcactctagctaattaactgagcccagggaaagggttgtgggatccttgatctagaccctttcagaagcacaaataaaacaacctggggcttgaaactggcatctaaagtggcaggggtgaggtggggttagggcatggggttaggggtggggtagagggaccaagccctcaacctgtaggatctgatgccatatccgggtagatagtgttggaaatgaattgcattagaggacaactagctggtatcctctgtaggactgattgcttgcttcatgtgtggagaaaatctccacaccttgtggtgtgagatcagaggaaaaattgcttatctgtgtgttttttcttacttacagggttccagtttctccacactcttgccaacacttgttattctctgtctttctttttaaattataattatcctaggagatatgaagtagtatctcattgtggttttgtgttgcatttttgtaatgactaatgacattgagcatcttttcctgtgcttatggtttattgtacagcttaaatatcccatcatgcttaggaccagaaggagttcagattttggattttttgggttttgttgaattttggaatattttcatatacataatgagatatcttgaggatgacacccaagtctaaacatgaaattcatttgttttataattatgattataattatataattataaattataaataattttgtgcatgaaagaaagttcatgtatgctgaatcatcagaatgcagaggtcactatctcagccacccatgtggacagtctgtggttgtgtggcatcaccctcattcctgcctctgaatgtatattcttctaagaagcgatcattttctaacactgattcacacatacatatttaacagtaaaaaaaaaaaacaacataccattaatatggtgaaaaaataaatgtgttcaggatagctaagcagtacagtagcatcaccagaatacctatgttagttcctggacagtggcaggaacaaacaacggtaggctttccgtcttcctctgccatgctgtgttttgattaaaaactctatcatttctaaaatgaggttatagaaaagaaagaaaatttttttaaaaagataagaattcactgtacgtggttttgttttttgagttgagcagaaacaccagtagcagttgagggacctggaagtgagtcctctaaggatgaggaggctttctgctggatggctttttaaatgcgtcctccagtcatcttcctcgttaacagtagtttttgacttcgacttctctctcgaattttataaactggcatgatttcttgttctattatgaatgtaccctgctgtagtccttgaataaacccatcacacattttcatcatgttgtctatgggcacttttttgcagtgttaattaatgtcatcatccgcttgtgttacgttggcactccaacgtttcagattttggagcattttgaattttagatttttggttagggatgctcaacctgtatatctttagagaaatgtctattcagattctttgcccattttttaacatttttccaaaaaattagagaatttttattatatgtatatgtgtgtgtgtgtatatatatatatatatacttttagagatagttgcctggaagtgtggtagcacaatcatagcatagctcactgcagccttgaactcctgggctcaagtgagcctcccacctcagcctcttgagtagctgaaaccacaggtgtacgccaccatgcccggctgacttttgtatttttaaatgttttgtagagatggggtttggctgtgctgccccggcaggtctcaaactcctggccacagggcccagctgtgttttttaattggcttatttgtctgtttatgattgagttgaaagcactctttctataatctgtatacaagccccttcttaattgtatgactctggatactgtcttctattgtattcgttatgttttcactttcttcatagtcatcatttatagtacaaaaggttttaattttggtgaagtccagttatctatatctcttattttgttgcttgtacttcccatgtcatgtcttagaaaccattgcctaagtgaagaaaacttagtcctgtatttccttccatgttttatagttgtaactcttacctttatgtctgtggcccattttgagttagttattttttctttttagtgcaaagaagaagctgaataattctgaataacagatagaatgtgttgggtgaatgttgagcgtctgctttaggtagacgcctcaccatacacacggaattcctggagagcaagacaagaaaaaagtagcatggcagctcagcccctactcatgcctattcagatctttgcatctggctgcaggacccaggaaacctacgagttattgctttaggaaaaatgtgggctgggatagaataccacaaataaacaaaggaagaaatgacaaatctgctaattctcaggttttctgttgatttattttcttgttttcaccacggatagaagttggtttataattttgtggctagtcctttagaaaatcttctatgtttggccatttttatttattttgctcctttctttccactctccagcctccttcccacccattatggaaagcagaaaaatgattttacagtataataacaagtatgtgttagacttgctcactattccttggccgttattaaactgaccatatgttctccattattttagctgtaccacagcctctgcttgatacgcagtagtttccaatggtctgttttggcttgacaaagtgggccaggaagtgactataactttctctttggctagggtttttggtatagtaagttagaggttccaccttattccacactggcccacgtatctgtagaatgggctgtatgctggtagccttaactacttctttggaattacttggtgttttatatactaagataactaagaagtgttgcagaaatcaaccaggagagcatactgaaaagcatatttctactgtctgttcagtgtttttgtctacaagatctatttttttagattggtgtttaatatatgtatatatatataaaacacacacatatatgtatatatatatatttaaagtagctgttgaaaagctgaggagcaggatttgacttttttgagagtaggatcaaatcagctttggaacagcagtggacatcacatctaacactgtgaagtatatacagccatgtgtcatctaaagaaagggacacattctgagaaatgtgtcataaagcgatttcatctttgtgcaaacatcataaaatgtacttacgcaaacctagatagtatacctactgcacacctaggctctatggcttagcctgttttttctaggccacgaacctacacagcatattactgtattgaatactgtgggcaattgtaacacagtggtctttgtatgtctaaacatagaaaaggtacagtgaaaatatggcattataatcttatggatcagcgtcctatatgtggtcattggtgagccagatgtcattatgtggcacatgactatatttggtcttccctctgagtttcctcttaaaatttctaggattttcaaagtggtatgtctttttgtatgctaatgaattaactgatgcctggcaacccttatgtggctttagaatggggctaccttgtccaagcttagagcaagcttatgcaacccacagcccatgggccacatgcagcccaggacagctttgaatgtggcacaacacaaatttttaaactttcttaaaacattatgaggtttttttttcaaagctcatcagctgttggtagtgttagtgtattttatctgtggcccaagacagttcttccagtgtggcccagggaagccaagagattggacacccctggattagagggttgagactttcagtcccatcccctaacctctggggaggggagaggggtgaagtttaaggaaatcaccaatagccaatgattgagtgaatcatgcttactaatgaggcctccataaaaacccaaaaggacagggtttgcagagctccctgaaagacgaacacatggaggttccaggacggcggtgtgtccagagagggcatggaactctctgccccctcccacatgccttgccccatgcatccctttatctgtatcctttgtaacagcctttatcagaagttggtaaacataagtggttccctgtgttctgtgagctgatttagcagattaatcgaacccaaggagggggctgtgagaatcctgatttatagccagtcagaagcgcaggtgaaacaacctacggctttagatgggcatctgaagggaaggggcagtcttggagactgagtccccaacccgtgggatctaatactgtctcgagttagatagtattgcagttgaattgaattacaggacacccaggtggtgtatcctgcagaattgattgcttgctcggtttgtggggaaaacatttggtcacagaagtcttctgtgtaggttgagtgagagaataggaaaagcacttccgtttagtttattcctgtgttctcagaatgtcataattagaactgagaactttaatctccacagacttgctgcaccagatgtaattgaggtcaaacttttttcatgtgcttattagccatttatgattcattttgaaagattttcctgttcacgagttttatattggagagcttgccttttattgacttacagaactctttgggttccgttaggacgtgttagagtaaactttaggtccttgagatgttgcagaatccctgaacaaaccgttttttcattgtcaggtgtatgaactgactcacaaagtatgtttttagcagtctcccttcatggatccttgaataaactatctactcttcagttttatttttaggtaggaaatatcttttcccttctataaagcagaagtgacatactggcatttttaacttatgatttatttggtctaaccaatgttttattaaaatattgagctaacttttaaaaactgggagatttcatgtaaaaatccagacttgaagcttctgttgctgaatttgaggaatgccaacactgagtgtgccttggcattgacatgaaatagtgctggtgccttcagagcacaggtacttggtcaccactccctcctgtgttctcataccttgcctgccttactcatttatattatctcctgaagcccgtgaacactgggcttatggcctctgcatacatagtgtatgactttatacttttgcccatgtgttccagttgtgagtttcattatgtcacactttgcaaccccaagtagcatccagagatggattttctatgaagccaatgcaggaagcattcccaaggctcccagaaacctgccatttttttgttctttttcttaaagagactccccgtgaccacctgcccagttgtgtgtaggtttcaggacccacaaaactagatctgcctctgccagcatgaggatctcctgtagaccttttaagaaataataaagcttcctaggctctacttaacccatgcctatgcagttagaatctgtgggcaagggatgacccaagcatctctacattttaagcatctcccctagtgtttgttgtcatgcacatacaggctcgagaaccattgtgttttaaaagataatttacttgagatgtttataaaccattttaacactaaaaggatgcattttggaatcatttaatacatttaaactgtagtttgatatattttactgacatgcagagctgaactgcttaggaaccactgccaattgaatactaatagtgagaagataattctgaaattgaaatatgtcaacaggaaaatgcaatttgattgttaaaaaaagtagtttacatttgttttttcaaggatttctgaagaaggtttctcatatctgtgaaactgtcattccattcatgtagaatttcaccagcaatttctgttatggtagaatttatgtaaatatttgcttttgaaaatattataagtataggtagaatcacgcagagattctggagtcactatcatgtatgatagtgtcacaagggaaaataatactatagcctgacacaggtacctctattcatattgtttggggaggttgaatggttgggtatatttttagttatcacagtgattggggatggagggctaggtggctactagcctttaataggtggtgatgaggcatgctagacaagttttagtccctgggatagtaccacaccaggaagaactattctacattctgtatggcctcgaatgtcctgttggacattcatgtaggagaaaaatatgtttctaatgatccggccttaggatatgtcaataaaaggttttttacttaaatggttttaagtatcagtgagttttctaggactgtaactaccatgtaaatcgagagaagattatactttgttttgtttgcaaatttactaaaagttgtttactatttcaaagtatcacatccaagaaagcagcgctcatgctcccgcatcaccatttcaataccgctgtatctgtccacactcgaaccttgctttcagcatgattctcctttaggtacaagcaagtgtctgactaacctgagcatttatgtaatgaaaatcattttaattttatttcccctttgtgatatttagggcattatatggattattttgaattttatatttaggcagttatattgttgatggatttcactgtaggataataaagaaggcattgcaaaatgttacgaaaaggtatttttgcccttaaagagttgagaattgctgttttaaagcgatggttcctaagcatcagggcacattagattgtcctgtagaagttttggaaatgatcattgtgaacctgccctagaaatactaatttagtagttctctaggaaattctagaaactccatgaaacttttttttttttgtgattgttttttttttttttaatttatttatttttttattatactttaagttttagggtacatgtgcacattgtgcaggttagttacacatgtatacatgtgccgtgctggtgcgctgcacccactaactcgtcatctagcattaggtatatctcccaatgctatccctcccccctccccccaccccaccacagtccccagagtgtgatgttccccttcctgtgtccatgtgatctcattgttcaattcccatctatgagtgagaatatgcggtgtttggttttttattattgcgatagtttactgagaatgatgatttccaatttcatccatgtccctacaaatggcgcacatagaaaattacactctttgtattgcgcagggaagtgaaggaaagcagtggtcttgggctgcaggtgacagtttctggggatcctggccgccccagtcctgccccgccccaccttgcaagccaacgatctgtttccaccttggatgctttccatgcttgttaaaaattcagattcttgaacctcactccagtaattctgattctgtttgactcagaaatctagtattgaatgagctctcggatgatcccgattcaggtagtccttggatggctgcttgagcaatcctgttctcacgggtcaggggcaataactgtgtggtgtgtgaaaaagaaagagaaaaaggaaaggtggggctcctttctaagggtgtgtgaggtaatgctaagagatttctgagataaagcagagatacgaaactccttcctggctggcgtttctctatcaaggagtacagtcagcttgtttgaaagggtagaacaaacactgctagaagaagctgaagccccggaagagatcacctggctccttttgtatgaatttaaactctgaggcataatatcctaagaaactgagcatatttgcaggtaaattatatatccactctagatattctttgaaaatcatgaagatagggactagtgcttaaaaaaaagaatccaagaggcaaaaccttaatctgtagaaaggagaattaaggaaattgtagagcctggtgagtttcagggcggtctttagccaagctttagaggattattaaaaatattgcaagaccagatagtcttccccgggtctgaactggcacttatgaatgacgactgaatggtgggaaccagggaaaggggcacggtacaggtacagtgccctccctccacgtagaagaccaaaaaggtggggtgagaggctttgagggtggtggaagtttgacaggttggtggaactggaagctgtgttgcatagctggaaacccacacattattcacattttctgaatggatgttattggaacacagttggagaaatgctgatgtactgggaacaggcctgggcaaagaatcaagaggcctagttttttgtttattagtatgtcaagtaccagatgctaaaaacttccttcagtacattcctggaagtatttactttttcaacacgcattcagtgaatacctgtagttgctgggctagaggtagaaatatgaagcctacagcctgactgtgaagtctggttggagaaacaggcaagtaataacatgattctgacacaggatgatacctgctacagtagaggtaagaacagaggctttgggaggctgtgaatttgtacctcagtcaggatggagagaaggcttcttggaagaggtgacatctgagatctgagcagagtttttgaagataatttagaacgggtgctgggaagaaagatgttttgacagtggcagaagcacatataaagctgtggtgttgtgcagaccatggcttggtcagagcagctggtgtcaagagggagcaatgaactagaagacttcaggtgggcagggactaggttatgaatggtcttacgtgccatgctaaagcatgctgtaagtgtgtattttattaattttttaaaaaaataatggattgattctccacatttagggtttaggaaatcagtctggaaatcattctggaagtaggaaatctagagatagattgtggttttggagaggtgagattggaggcagtgaaccttgttaggatacataaatacataaacacacacgcccacctgcccacacccacacaccggtggcttagacaaaataaaagttctcttccatgaaaggaatccagatagatgattcacagcttgtatgttggttccacggtgttgcaggtcctggctactttgggctagttggtctgccatccttggagattttctcatcttctgatgtgtttgcttgagctccacgttcctgagagcaggaatgcaaggggcagggttgggggtgggaaatcgcaagagcaaaggggcatgcactagctgtaataaaaggatatggtaagtctttaacatccttgataggttcttggaaactgcgacttcaagcgaaacatataggatgtgtaacaaaactaattatgttatcaatataacaaaacagtgttatttgaggacttgctgtaggtcgttttgcttaaagtcttggtttccaagaactaatctgcaatgttgagtgaggacttgcttttattttggagaaattgccacggaagacttctagttagagctcattgcccctgtgtcgtgccatgatcacttttagctgtaagagaaaggctgaaaatacagtatttattcagcggccgtgtgcctagctaaaaatggaggggttctatcagtaagggaagaggagaaatggatagtggggtaaaccatctccatctctgcctgaaagtagtgcaggaatgcgagggacacataatgaagacctgaactgaggcagtggagatacagaagacgagacatactgcagggattgctgatattggttactgatatgatacgggaagaaaagaaggtgaaggcattgagggtagtttctgctttgggcagctgggtggatgggagggaggatttgggggtaaggtggaagaatgctgacactttgggacatgttgcgtaggagatgcccatggcacattcagatgcagatattcagtgggctggtgggtatcaggtctgggctagagggaagagattttatattatttaaaaagaaatgttaaagacttctctcccttatttccttttttttcatttccttcagctttattaagatataattgacaaaaattatatagatttatggcatacagtattatatcttcatacatatattcgttgtgatatgattaaattaaattaattaacatattctttaccttacatacttatttttttgtggtgggaacatttaagatctactcctttagcaattttcaagtgtgtgatacattattgattataggcaccatgctgtctgacagatctctagaatgtattcattccatctaactgaaattttgttccatttgaccaacacctcctcatcctcctccctgctgtagcccctggtaaccaccatcgtactctttgctactgtgtgctcaacattttaagattgtgcacgtaaataagatcgtgcagtatttgtcattctgtgcctgacttatttcacttagcataatgtcctctaggtttatccgttttgtcacaaatgatgggattttcttctttatttttaaggctgtatagtattctgtttgtgtgtgtgtgtgtgtgtgtgtgtgtgtatatatatatatatatatatatatatatatatatatatatatatatatatatcactttttttaaatccattcagcaatccatagacactgaggtcaatttcatatcttggctcttgtgaataaagctgcaaagaatatgggaatgcagatatctctttgacatgctaacttcatttcctttggctaaatacacagaaatgggattgctggatcatatggtagttctatttttacttttatttttattttttttgagtcggagtttcgctctttttgcccaggctggagtgcaatggcacgatctccgctcactgcaacctccgcctcctgggttcaagcgattctcctgccttagcctcccgagtagctgggattacaggcatgtgccacccatgcctggctaattttgtacttttagtagagacagggtttctccatgttggtcaggctggtctctaactcccaacctcaggtgattcctcctgccttggcctcccaaagtgctgggattagaggcgtgatccaccatgcctgccctatttttatttttttaaaggaacttccatacttttccaccaacagtgtacacagttccccttcttcccacatggctccagcatctggtactttatctttttgatattagccattctaacagattcgaggtgataccttatcgtggttttcatttgctttttctggatgatgattagtgacattcagcattttaaaatatatctgttggccatttgtatgtcttcttttgagacatgtctgtttcagtcctttgcccataggaggtttttaaattgggttatttgttttcttgctattgagttgtttgacaaataaaatgtatatatgtatttatatcttggatattttggatattaactgcttataagatacatgatttgccacgtatttactcacttctgttggtgtcttttcaccctgacaattgtttcctttgttgtgtgttagctttttagtttgatgcaatccaatttgtctgttttgcctttcattgcctgtgtttttggtgttatataccaaaaaatcatggcctagacgagtgtcaagaagccttttttcctatgttttattctagtagttttgtagttttgggtcatacatttaagtctttaatccatttgaggtgatttttgtatatgttgtgaaataagggtttaatttcattcttctgcatgtggatattccgttttcccagcactgttcattgatgttctttccccattgtgtgtccttgatacctttgtcaaagatcaattgactataaaagtaaggctttatttatgggcttcctattctgttccattggtttaggtctgtttttatgctagtaccatgctgttttggttaccatagtttcgtagtacattttgcagtcaagtaacgtgatgcctccagctttgttttgcaccagattggtttggttatttggggtctgttttggttctgtatgaattttagaattgttcttccatctccctgaaaaatgccattagaatatttataagtgttacattggatctgtagattgctttaggtaatagggacattttaacaattctttcaatccttgaacatgggatatctttccatttatttttgtcacttcaacttttttcattagtgttttatagttttcattgtataggtcattcactctcttggtcagatttattctgaagtattttactttttgtaggtgttacaaatgagattattttttgatatctttttttggatagtttgttattagtgtatagaattgctactggtttttgtatgctgattttgtatcctgcaaccttactgaatttattagttttaacattttttttggtggactctttaggatttctgtatataaaatcatgtcagttgcaaaaagagaccattttacttattccttttcaatttggctgccttttatttctttttcttgcttaattactgtggctaggagttctagtactgtgctgacagaagtggtgagagtgggcatccttgccttgtttctcaagagtgtgatgttagctgtgggcttgtcacatagggtctttattatgttgaggtacattccttctttacctgatttgttgaaaggtgttttttttttttttctttatcatgaaagggtgttgaattttctcaaatgctgtttatgagtctatggagatgatcttataatcccccatctggaagggaatgtgtgtaggcttgctattggagcctttgggcaggctggttcctggctcccctggggtttgcttagagcctggattttcaggttcaagtctggagcctgggtttactctgatgggcccggagcttgtgtctgttgagttgggcctagagcctgagtttgtgaggacaggcccagagcatggatctgcaggggccagcctggtgctgagatgggcttggtacctggatcaatagggttggggtaggagcctgagttcgcagtggctggcctggcattggggtgtgcttaaagcctgagtctgtagtggtagaggtaggatctttagtttgtggggaccatcctggtacctgggcctgtacgggcagtcctggatcctgagtccatgaaggccagcctggtgcttagaccctgggttcactgggggcaggcctagatccttagtccgctggcactggtcctgcctggagactgggtccctagggatgggcctgggtcctgggttcgtggcagcttgtgtggccccagggtctgctgaagcaggcctggatccttggttctgtagagcatgaggcccctgaggctggcctggctcctgggaggcctggagtctctatctgcaagggccagactggtttctgggtctgtgggtgcaggtctgaagcctttggccattggggcttagaagacattttggaagtgggtatgattgcccaggaatcatgtggaaaatgacaggaaatctgaagtttgcactctaaagaaaaaaaaaatgaacaggttgacaaagtagtatttaaaataaatttagaagaatcaacccgagatagagaagggaaactttaacagaaaaatatttggaaaacgagagagaggattttcaaaaggtggcagtagttgcagagacatgccatggatgagtccagtccaataaagactgaagcatctagcaattaggaggtaattgaatgcattgaaataggagaaggagagtgtgtgtgtgtgtgtgtgtgtgtgtgtgtgtgtgtgtttgtgtgtgtgtgtgtgtttataaagttgtttagattaaaccagattttttttttaatgatcacacaattattgaaattactcagggtagatggtggccgtttcttaagtagctctaggagtgtactctacatcccctgggtgccttgccactcagcagcccacttggggcttttgtcattgtgacagcatggtaactgtttctctcaagctaaaatttagggtgtatttcctgttgcatgaaaatgttttttgggaatagtgggtagatatttaatacagtggccatcatgaactagcttgaaatttgtgatgaagcaatagggtcccacctgtcactgttcactgctttctctgaacttcaacatcaggttgccaaagaggaggagggttctggtcgggactgaagcagccctggtcaggttgtggaactaggtgtggtgagtgagtgtcttcatttcttttaggagaatcctagccacagagatgataaacattaacaggcacaaaatgattttgagaagtggaccatcttttagattttcacctaattaaagatatctaaattaaagatttttaggttttccttcaaagaatatatatatttttttccttctgaaagcttagaaagaaatttaagtacaaaagttttattccttttaagaactcagttctgttaatagttagacaacactgccccctggtggactgaacctgcaacacttttcagtagcggttaacattgtgaagcgctgttcctgaaggatattcctgctagcagatttccttcagatttgtttcggagttaatactcttttgttctttctgcttaatttaatctggaggtttgtcaaaatcccagtggtgtacaaatattccctgttatatcttaatctcattatgacattatgaaataaggatctgggattttcatggcaaaaacttctcagatggacattttggtaggccccagaagacaagatgtgttaacaagaatatatgaaacctggtctagtgggttgatttttttcctcatgtataaatttttcaaaaccttctgaagaaatcattcttgttggagtcataataattgaaagactaatgtgaaaggtcccacttaacttggctgtttgtggacggatagtttttgagttgttgcatttgttttggtgtgtattaagttacggtgtaggctgacaaaatgtgtaagatatttttcttaatttggggtgttcaaacctgagttctctgcttcattgtgttcatgatgactagtgatgtgtgtggtggggggtagagtgtgtgtgtgtatctgtaggtgtatgtgtacatttatatatctatgtctatatatatatccctgagttatgaattataaaaaatgaaaatgctgtttggaaagcaaacataaagatttcattttctgttttatcacaccaaattgcagaagtgaacgctcttacatcattattatgcaacagacactctgctaggaactttttgtattattcttggaacctcagacagatcttctgatacagtttctcccctcacccccattttatagatgaggttcctgagactcactgaggcccagtaacttaactaagctcaggttacacagcaaggaagtcacgggtctgccatgcccagtcaagcatgacatcaaggctgtctctccaccatatcctgcagccttacaggaaattggagtgaagtgccactggctcccaagtgacagtgtgctaactttccttgaaagtaggctatacttctggctttgttcttaattgttagtattgaatacattatttaacttctctggctttatttttgttatttcagtctttaaaccaaagtctgtgtctgtgtctccctgtggtttgaggaaagaggggataatgctatgaaactgtgctcccacccccactctaccgaaaacactccctcttttatctgttttattggttgactgattgattgacatggcctcattctattgcccaggatggagtgcagtggcatgatcatagtttactgcagccaggaactcctgggctaatgcagtccttccaccccagcctcctgagtagctgggactacaggagtacaccaccatgcctggctaacttattttttttttttttatttttttgaattttatgtagagacagagtcttgctatgttacccagcctggcctggccttgaacttctgtttgttttattttttcgacttctgtgtcagataccatttgaaggcacaatttctttgttaaaataaaacaaaacaaaacttaaaccactaaactatatgatttttcccatctagctgaccatttctttatggatcttggcataccacaacagctttttgtatttttcctttggaagagaaagaggatatggcctggggcatcagacttttcttttttttttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgagttggttccaagtctttgctattgtgaatagtgccgcaataaacatacgtgtgcatgtgtctttatagcagcatgatttatactcatttgggtatatacccagtaatgggatggagacttttcaatacaagttcctttccattgggagcatttgggtgccaatgacagggcattcagggaggggagcgaactcttcgtggggcagtcctctgtgtctcaggctgctgaaacatctaaattccttctctgttataattgggcaccagcctgccactttttcctttcgctgtaacttccagcaaccaaagttaaagcccctgcctcccagcggagggaaattacaatgtcaggaatacgatagaagtaaaaacatataaaaacaaagaaacataaattacaatttctgtttacttaaaacattgtagaattaaagaagtttaaaaacaactacaggactggcatggtggctcacacctgtaatcccagcactttgggaggccaaggtgggcagatcacttgaggtcaggagtttgagactaggctggccaacatggtgaaactccatctctactaaaaatacaaaaattagccgggcatggtaacgtgagcctgtagtccgagctgctcacttgggaagctgaggcaggagaattgcttgagcccaggaggtggaggttgcagtgagccgagatcatgccactgcactccagcctgggtgacagggcaaggcttcctcttaaaaaataaaattaaaaataataataataagaagaagaaaaatacaaaatagccgagaagcaagaccaaatacccttttatccatagctaagttatctgtgcctttatgcaacaatattttgtgtgtgagtgcctataccgttcatatattgaagcatccagtcacagtttgttcatttggtaagacagtggtgttaatggggccacggtcaaaccttaagggagagataacgttcatttctgtacatcaggagctttgcaagctattttacagaaatatgtttgttggttttagggaaacccaagcaaattaatagggatggctcaatgcaatacccaactacactaggaaaaagcaacttagagtatttgcccttttgatgatgattgctaaatatctgaaatgtaattcctttagttacccttggaacaattgtcatagtgaactttgtcatagtaaactttgagttggttaaaatgagtagaattaaagtagactgagaccctgttttagttttctatttaaagtgaaaatgactagagactcttgttttgtgtgtggctgcaggtttcctagaatttgtcgggaactgagatttgtatagttttgattctcatatttagatagttttaaaaaggggagggcaggaaataatgacgtttaactaatttctgcacataattatggagtatttgctgtgtacccaatattgctagtcattgcttataaggagataatgaacttacaagcaagacaacattcatacgaggaaccattaaatagaagatgatacgtaattaagtgccaaatgattggtacgaatctcatgaacagatgacttgtttcatgctgaagatcctgcacagagacagacgtgctttcataaggagacagactgtttgagatgatcaggatcagaacgggaagtcagggatatgtggttatcatatggacaggaggggagaagcagtgcagggtgaaaggggtaatcagaggctttttccaggtatgctcatttgttctttgccttgaaaggtaagtattatttgaatacatggaaagcatggggagaatttggttctaaaaagacctgagactgagtacaggatgttgtggaggatagtagattattgactaagatggagaagtaaattaagatatgatcatggaagaccttaaatattaatccaaaaaatggtgatttaaagtgtatatttccaaaagtcttacttaattgcttaatttgggtgactgccctctttctggggggcctccactccaccttagaatttgcctctattgttgaaccaatcattcattctgaaaggcacaaatttatagatatttcttttgccaacagagatgaaactacatctggttatcttattggcatttggctatttttgaaattctatattaatttacctgttatcaattctgcattcatcagtttatctacatccatcaatatatgtatattctacagatagtttgattttaaccatttcacgttgcatacttaaaatttagaattttgtgatatattgctgtcattcttgtgtgccgagtgcaaaagattataaaaattaaatccagcttagcaatacatttaataaattcaacttattgaaaaaagtttaaatgaaaggaaattgaaatgcggcaactatgtatcattaatgttactgtttgttatttgtctgttgttgtattcacggggttgttactctgttggtacagtcatgtgctgcttaatgatgggtatatgttctgagaaataggtcatcaggcgatttcgcccttgtttgaacaccagagtgtacttgcagaaacctagattatatggtatatgagacacacctaggctatatggtatagcttattgctcctaggctctaatcctgtgcaacatgttgctgccttaatgcagtagacagttgtaacacaatggtaagtatttgtatgtcaaaacatatctaaacatttaaaaggtacaataaaaatgcaatagaaaagataaaaggccaggtgcagtggttcatgcctgtaatctgagaactttgggaggctaaggtgggaggatcactggaggccaggatttcaaagaccagcctgggcaacacagcgagacccccatctctacaaaataaaataaataaaatgaaacaatgaaaagacaaaaaattgtaccatcatatagggcatttaccatgcttggagcttacgggactggaagttgctctgagtgaatcggtgagtgaatatgaaggcctaggacatcactgtccactgttgtagactttatgaacaatcaacacttaggctacgctaaatttataaaaaatatttatctttcagtaacaaccttagattactgtaactattttactttgtaaacttttaactttttaaaacctttggactattttgtaatgatacttaaaatacatatacattgtacaactatgctaaaatattttccttattttcttattctataagcttttaataatgttttagtttttatattttctttttaagctttctgttgaaaatgaagacacagaaacacacattagcctggacctacccagggtcaggattttcacgatgtcactaggcaatgggagtgttttgcctccattgtaatcttacgtgtatgtatataattaggtatataatcttttgtatatgcagttagtcattgactgaaatgttcttatatggtgcatgactgtatttgtttttatttggaacttacttgtttttatttctaaatctgagttttaaatagacactacaattactttcttatgctaatttttcttagttcaatttattgttttaggatatgatactaccacttctgatttgaaggtatgaagtttagcaataagatcatatatattgtccctacaaaacctgtgtttgtgcccctcatatacatggcaggatcaccaggccatcagagccttcctagcaagtagtaacatgaaattgaaatctttaagtctttggtaatattcctgctctcccctcacccgtttgctcctaactatgaatttccccatttccaatgtttatgatcttcgacaccttctaatttgggtatgaattttaaaaacacggccacatcttattagtgcattgaaatttctttgaatgtcttgtgttaaaaggaaaatttattaggtgagttacagctgtgagtagctaatatgagaccctttcaggcagggtttcttaactttaggggatctggagcacccagatatttgatgaaaaattcgtataaatgtttatctgatattttttgtcaggagagggtctgtagctttctcaaggatgtctttctcaaagaaaaccacttttctgagacttaaagaacagaaaaatcagtgtattatatttttgccggtctttcagatacaactgttatcctagttcaatcacactaatatgatgtttactataaaataatctcttctaagtagttcagttactgaatatatattgttataattgtttttgcaaagcgtatctcattctagaaagatcaaagaaccaatttatactttgtttcttttttcatcttgaaaaatgatatatttactgtaaagagaccacttgctttaatcttagtaagtatagggagtggtaaaaattattttaggcctatattcgtgaattatttgtatgttaatatcatccagtaaaaaataatgaataccttttgacttcagaatactatgataggtatttaggatctagaaaatgtaagataaaaagtaagtagggaagacagtatgaaattatgaaaatataaggacgcatagaaaagtataggcaatatatgttttcagaataaaagaagaggccgggtgtggtggctcacgcctataatcccagcactttgggaggccgaggtgggtggatcacctgaggtcaggagttcgagaccagcctgaccaatatggtgaaaccccgtctattaaaaatacaaaaattatccgggaatggtggtgtgcacctgtagtcccagctactcaggtggctgagacaggagaattgcttgaacctgggaggtggaggttacagtgagctgagatcgcgccactgcactccagcctgggcaacagagcaagactccgtctcaaacaaaagaagaaaaggagaggagaagtcactgagagttggtgaggcatggagagcttcattgagagctcaggttatgaaagatgagtaggacaaaattagagagggggaaataatttaataagcaaaagtgcagaggtgatcatgtaacttaggggggatgctgagttgaccaatggagaggcagctttttgtaatggttaacagcttggattcttcatccagcttctagtcctggctataagctacttaaaacactctcgcctcagttttttaatttgcaaagctagtacctttcttataatttaatatggtatgtatttgctatattttaaaagaaaaacctaatacacagtgccagcaagatagcagtagggaaataaggtggggagttagtagccagattgcaaaagttcttgaataacaagttaaaggaaagattggcaaactatggcccttgggctaaatcctattcctctcttgtctttctagatcacattttattggaaaacagtcttatgttaatttactattgtctgtggttgttttggttgcaatggcaaagttgcgtgtttatgtagagaccttatggcccagaaaggttaaggtatttactgtctggtcctttacagaaaaaaatttgctgaccttgagtaaacaattacagctgtaacataattacagaagatgtacttaaaatttttattttgttttgttatttacttccaagatacaatggtagtacaggtattgggtacacattaccatttcaaaagggagagatcagccaaaagaaaggggtagtaggccccacacaagtctgaaacccagcagggaagacattaaaccttgaagttccaacatagtccttgacgccatgtcttgtatcctgggtacactggtacaaagggtgatccgctgaagccttgggcagccccatcttcatggctttcttgggcacagcctgggttggagtgcaatgcctgcagcttttctgaagttcagagtgcacactggcagtggctgtacaatcctggggtctataaggttgatccctcatgagtggcttggtgcctccctgaggtaatgagtagttctcactctgttagtttatataagacctagttgtttaaaagagcctagcacctccttctctctctcttgttccctctctcaccttgtgacatgcctgctatccctttgccatgtaccatgagtaaaagcttcctgaggtcctgaccagaagcaaatgctggcactatgcttcctgtacagcctgcagaactgtgagccaactaaacctcttttctttataaattactcagtttcgggtgttcctttatagcactgcaaaacagaatcatacacttccccaggcagaagtagagccacatcacctacccctctccccgccttcttgggctgagctgaagtggtgccctttctcctggggaaacagtactttggctactcggagaagtcacaccttccctcagcctaagttggagggtgccacatgtccccaaaacggtgccttggccccccagaaaggtcctatatcctagtacctaagctgaagcagcagcctgcatcctagggaaactgtgcctgggccatccagaacagtcaaggcccccaggcctgagctgaaggagcacattggtccctggggtatcagtgccctggctgagctaagtagctacacatccctgggctgaactgacatagcaccccatataacagggaagtagaacagtggcttagctgagacacactggcctatagaccaaacagctcttgtatcctgcttccgtggagctggtctaggccctagagtctgagctgttgggacacatctgttcttgaggaatggaatcatcaatgtgctatttcctgaccccacactcttcaccccaccatgctgcaaaaaacagctattctttgccattcccaggtacttgctgccactgcacctggcctcacagaggctcagatgctgacgatcactgccaacccagggtctagagtcactaccacaaggtgactcattccctgggacccgagttgccgttcgggtcaagttcccaaatcgcagtcataccttgcaccttgagcctaaaccttcagagtatcactttcctggagttgggtgagtgcttcactgtataccctaaaagtaaaatcacagctacaacctggccccctgagcctgagctgctagggagtagctctgagtcacagatcctggttccgggggcaacttacatccaatcctttcacagacagcaagttcgcactccaagatgcaggtgccacaggaggttcacaagattctgagcctaggaccctggccccacagccactccaagcaactcagtgctgttacagccacttgtaggccatgtcagacctgacacctagagaaatcccctcatctaagtctccccattgtgtggaaaatgagaataggaggactgaagacattagcagcctatgccactgtcaccactgccacgaacatctacaacatacgccactgaggcacccacagttattgctgacattgaatgcagatgaagagtctgcacagagactctactactgcacctgtctggaaacagttaccacattctttccaaccagcacagtaaaaccctactgaaggtcaaagtctttctgtacaaaagccagtctagtaagtttggaagaggctaccgttccaccagacatcaacacacagatatctgccacacagacatcaacacagggagacaagacatgaaaaggcaaggaaatatgacaccactaaagaaacataataactctgtaataacagacctcagtgaaaaagaattcaatgacttggtggaatatgaattcaaagtaataattttatggtaactcagtgaaaaacagaaaagagagacaatttaatgaagtcaggaaaacaattcaccatgtgaatgagaaattcagcaaagagagagaaattataaaaaagaattaaataaaaatcctgtatttgaagaattcaatcagtgaaataaaaaaatacagcagagaccttcaatagaagacttgatcaagcgtaagaatctctgaagtgaagaaagcctataagacttgtgggacaccattaagtaaataaatatttgtgttatgggatttgcagaaggaaaacagaaagaaaaaagcatagaaagcatatttaatgaaataataactgaaaacttcccaagtttggggagagatatggacatctagagccaggaatctcaaaagtctccaaataaattccacccaaaaaggtctttttttttcttttttcttttttgcctgaggcacatttatgtcaaattgacacaagtcaaggacaaagaggaaattctaaaaacagaaaaagaggagagtcaaatcacatctaagggactctccattagactaatagcacatttctctgcagaaaccttacaggctaggagagaatgggctgatacatagtcaaagagctgaaagagaaatactgccagccaggaatactatgcccagcaaagctatcctttagagatgagggagaaataaagtatttcccagacaaacaaaaactgagagaattcattaccactaggccaaccttacaaaaagtgctcaagggagtcctgcatctggaagtgaaaagatgaaaatcactatcatgaaaacaggcaaaattataaaactcactggtggagcagatacacaaaggagaaagaggaaagaatcaagacttaggctacagaaaaccaccaaactgcaatgatagaaaaagaggaagaaaggaacgaaaggaggaagaaaggaacaaaggatatacaaacaacttcaaaaacaaattaacaaaataacaagagtgtgttctcgcctatcaataatacccttgaatgtcaatggattaaattctccacttaaaagatatagactggctaaatggatgaaaaaacatgacccagctctatgctgcctacaagaaactcactttacctgttgactattaacaacacaggttttgacctgcacaggtccacttatattcaaatattttaaacaataaatatgttgtttaattttttgggagatttgcaacaatttgagaaaacttgcagacaaaccatgtagactagaaatactggaaaaatgaacaagagttgtgacatgaattcataaaatatatgtagatactagtttaatcatttattaccatgaaatagaaacacatctactttaaaaagttaaagtttatcaaaacttatatacaccagactgtacatggtgccatttgcagtcccgagaaatgtaaagaaacataaagatgcagtattaaatcataactgcatacaattaactgtagtacatactgtactatataataatgttgaagccacctgttgttgctattgcaatgagcttgagtgttgtatctgcttaaaacactgtgtgatgctaacagctccatgtgaaccattcatctgtccagtaaattatgtgttgtattaaaaagtgatctccatgttggtgcacacctgtagtctcagctacttgggaggctgaggtgtcaggatgtcttgagcccaggagtttgagctatgattgtgtcactgcattccagcttgagtgacagagcaagaccctgtctcccaaaaaaaaaaaaaaaaaaaaaaagagttgtctctcatggtttttgtgtatttttcatcatgtttagttcactactataaaccttaataacaccgtggaacccatacaaagtaccactagtgatgctggaagtgctcccaagaagcagggaaaattcatgatgttataagaagggtgaattgcttgatatgtaccaaatggattgaggtctgcagctgtggtcacctgccatttcaagataaaagaatccagcagtgtaagtaccgttgtaagaaaagaaaaggaaatttgttgtcactgcagctccctcagtaggcacaaaaccttgaacttttttatattgaaaatgtagctgttatgtggatgcaggatacctataagaaaatcatgcctatagactctacaatgatttaagaaaaaatgaggttagtgtatgacaacttaaagcaaaaggaaggtgttagatctaaacttggagaatgtaatgccagcaaaagatggttcgataattttagaaagagatttgccttaaaaaatgtcaagataacaggagaagcagcagacagccaagaagcagtagacaagttcccagacaccattaagaaaatcattgagaagaatggatatctgcctggcaggtttctttcttttttttcttgtagaaaaaaagtgccccctttctggaaaacagttccacaaaggacatttattagtaaggaagggaagtgagtacgaggatttaaggcaggaagggataggccaactgtattgttttatgcaaatacagttggatttatgatgaggaatgcccttgtctataaatttctaacccctgagccttgaatagaaaagataaacacagataccaatctttgggttatataacaagaagacctgaacaacaagaactcttctgctggattggttccatcagtgctttgtccctaagttcaggaagtaccttgccagtaagggactgccttttaaagttcttttgatataggacaatacccttagccacccagaactctatgagttcaacagtgaagacatcgaagtcatctgcttgcccccaaacacagtatctctaattcagcttctacatcagggggtcataaggaccattaaggctcactacacacagtgttttatggaaagaattgttagtgctatggaagagaaccctgacagaacatcatgaaagtctggaagattgcatcgttgaagattccattgttaaaggaaaagctgtgaaagccttgaaatctgaaacaataagttcttgctggagaaaactttatccagatgttgtgcaggacttcacaggatttacatttgagccaatcaagaaaatcatgacaagatattgtagatatgggaaaaaaggtatgaggggtggtgaggaaggatttcaagatgtagatatcagagaaattcaagagcaaataggtatcacaccagagaagttaacagaagatgaattgctggagatgagtgcttcaaaattagtgccagatgatgaggaaaaagacgtggaagaagcagttctagaaaacaaattgacatgagataatctggcagaatggttcccatgattccagactgtttttgacttcttttatgatgttgacccttctatcatatgggcactgaaactaaagcaaacagtggaagaaggattggtactgtatagaagaaacatttttggagaaatgaaaaagttaaaaagacagaaactatgattatgtctgtacatttacactgaatgtgcctgcctctcttgcttcctgttcttcttcctctaccttttctgcctctcccatccttgagatgaggacaactcctttctcctcctcttcagcttattcaatgagaaattgaggatgaagacctttatgatgattcatttccacttaatgaatagtaaatatattttctcttcttcatcattttcttagtaacattttcttttctctagtttattataaaaataaagtatataatacatacaacatgcaaaatatgtgtccattccctatttatattatcagtaagacttctagtcaatagtaggctaatatgttagtagctaagtttttggagagtcaaaagttatgtggattttcaactgcatggtggtggtgctcagtgcccctaaatcccatcttattcaaaggtcaactgtagactgaatgtgaaagtatggaaaaagacattccatgcaaacagaacccaaaagcaagcaaatgtagtcattcctatatcagataaaacagactttaagtaaactcatgtaaaaagagacaaagaaggtcattatacagtgataacaggatcaattcagcaagcagatataacacttataaacgtatatgtacctaatactggagcacccaggtaatcaaagcaaatattattagatttaaattgcacttaaacaggacagtaatagttgggcacttaaacacccctctaagcatcagatagatcatctatacagaaaacaaacaaagcaacattggatttaaactgcactttaatcaaactctcagcaagttaggtaagaaggaacatacctcgacacagtcaaagccgtatatgagaaaaccatagccaacattatactgaactggggaaagctgcaaacttttcctctagctctggaacaagacaagaatgaccactttctccattttttttcaggagtactagaagttttagccagataaatgatcttatataaataaaactatgaaagcttcaaaaaataaaaacctctgaactgaccgtctaattcagtaaagttgcaggatacaaaatcaacttagaaaaatcagtggtgtttctatataccaacattcaaatagcagaaaaagaaagtaagaaagcaattgcaggtacagtagctacaaaaagtaaaatacctagggaaaaatttaaccaaggaaatgaaatgtctctgcaaggaaaactataaaacactgatgtaagaaattgcagcaggcatatgcaaaaataaaaacacattgcattttcatgaattgggagaattaatatggtaaaaatggccatactacaaaaagcagtatactcattcagtgcattccctatcaaagtaccagtgtcattcatcacagaaatagaaaaaacagtcctaaaatttgcctagaaccacacaataccctggatagccaaagcaagaagaacaaagcttgagacatcacactaccggactccaaaatatactgcaaaaccatagtaaccaaatagcatagtactgtcataaaaacagatacacagaccaatggaacagaatatagaacccagaaaaataaatctcatctttatagccgactcattttcaacaaaggcaccaagaacattcactgggaaaaggacagtctcttcaataagcagacacatcacgtctcaaaagaagacatatagatggccaacaggtatatgaaaaaatactgaacatcagggaaatgcaaatcaaaaccataatgagatattatatcaacctagctagaatggctgttatcaaaaagacaaaacataggccgggcacggtggctcacgcctgtaatcccagcactttgggaggctcaggtgggcggatcacctgaggtcaggagttcgagaccagcctcaacatggagaaaccctgtctctactaaaaatacaaaattagccgagcatggtggtgcatgcctgtaatcccagctactcgggaggctgaggtaggagaattgcttgaacctgggaggcggaggttgtggtgagccgagatcatgccattgcactccagcctgggcaacaagagcaaaactctgtctcaaaacaaaacaaaacaaaaaaagacaaaacataaaaaaatgctagtgggattaagagaaaagggaaactcttacacattgtaggtgggaatgtaaattagtaaacccattaaggaggccaggcatggtggtgcacgcctgtaattccaacactttgggaggccgaggtgggcagatggcttgagctcaggagttcaagaccagcctgggcaatctggtgaaacctcatctctacaaaaaatacaaaaattagctgaggtggtggtgtgtgcctgtagtccctgctacttgggaggctgaggtgggagaatcacttgatcccagggggtcaaggctgcagcaagccaagattgcaccagtgcactgcagcctgaacgacagagcgagaccctgtctcaaaaataaaataaaagtatagccactaaggaaaaacagtatggaagttgctcaaaaactaaaaatagagctctcatattatgcagcaatcctaccacttggtatatatccagaaaaaaggaaatcagtatgttgaagatctatctgcactcccatgtttattgcaatactattcacaataaccaagaaggggaatctacctatgtgtccatcagcagatgaaagcataaagaaaatgtggtatatacacacaatagaatactcttttgcagtaacaaagaatgaaattctgttattcatggcaacatggatgagttagcttggggacattatgttaagtaaaataagccaggcataaaaagataaataccgcatgttctcacccatatgtggaagctaaaaaagttgatctcatagaagtagagtagaatagtggttactagaggcagggaagtgtggaggggaaggggagtaggtatagccaaaggttagttaacggatacaggatacaaaggtacagctagctaggatgaataagttctagtattctatagcaggactgggtgagtataatttacaaacatttattgtatattttcaaatagccgaaagagtggacttttaatgttttcaacacaaagaaatgataaatgtttaaggtgttagatatgctaattactgttctttgatcatatcacatcatatatgtgtgtggaaatacactgtatcttataaatatgtgcagttactatctgtaaactgagagtaataataaaaacccccaacacacaggtttcttttgtgcttttgtcagaaattaaaaaaggaaaagtgctataggaaaattaatctagcaaacttgcttagagtggattggaagatatgaaccagtgttgaggagggagacttgttagggttggcatttaattccaaaacgaattgtatgcactgtagacaagagatgctgataggaatataaatgcgtaaatgcatgagactttcagaaagtcatgatagtcttggtgactgtagatagggggagatatgatgactctgaagtttggcagtaaagtgacaggagatgttaatgatgcatctgaaataggaattctccaccatgagctagtttttcagggaaggcaatcactttggttttgacatgttaaatgtgtgacatggggcatctgccagacagttgggaattgttgactctttgctgtattctgcttctctggatatgcccaactttccaggggatgataggtgcagggggcacacagttcagagagcaggcttccttgattgccaagagcacatacaggatctcaggaaagtgagactctgtcctcagtgcaggattcctgttttccgttggtgtctttcaaagggtggggtggccttctgagataatgtagatatgtaacagcatggcctgtcactggcaatgacttgaccactgtctgtgagagatgcacaggacagagtacccaaaatctctcttgagagctttaacacttcatacaaaactcagatccttccctttcattcaaaacatgagatacttgtcccttccggatgtctcctcagaccttcccgcaaagtgagctaactagaccatgtgtgagcttctcctggttatggtttactttgtatttttttctcattacgttattatcatagggtgggagttccgattgtcaagacagatgcgaatgtagctttgagatggttaattctgcttggtaagatttcttttgtatttgcctttctttattcttggggttaaaagaatacaatctcatctacagttatcttgctttcatctctccttgttctgttacccagttcaagtttagactcctgcctcagatgtctgttctggctgattgacatagttgcttctgaatggactaaattactgacatcttttgcttttcctgtgtaatagtttctatttggtgattccttctcacacaacggaactgtgaggtagcctgaagcctaggggagatgtcaggtctggacacctgaaattatcatcatagagctatggaattattgatgtagagccttatatttagtcattttgaggttttcatgtgccgcttcatgtgacttctgtcattttaatcttacaaaaacccgtgaagtaagcatcttgtttgcctacagtgattgtttgaattaggttcaaaattaattgtacaaaagcctgggagtacaaatgtactttgtagtgagtacaaaaggctggaaaagaaaggcagaattactggcccaaatcacatggtaatgtagcaaaggctggttcccagcactggtagtaataacagctaattcttactgaatatttcctatgtgctgggcactgttttaagcaatttatatatattgactgacttagggtacatttgccaccgcaccggtgtgttgattggatgatagatattgcttccaagctcttgcattttgaaaggcagagaatgtgaaataagaagaacagcgggtgaaaaactaatccctgggccttcacctatcactaaaggggagtgggagaagtacaacaggccaaggaaatggagcagaatggcagccgtggcagaaccgcagctgggagagcatgttgcctgtgagccagtgagagagagggattctaaaagaaatcctttaccctgcctttcctttagttggccagactgtgctctgctcctgggcctgggcctggagttctgatcctgcttccctgccctctagcacatggatgtgctctgctcctgggcctgggcctggagttccgatcctgcttccctgccctctagcccaccgataccctcattcatccctacagagaggtggaatgatacatttcactttacttgatacttgagacgaaactagactgtttgaagaaaatcttatactgaaagaaagaaaaaataaataaaaagaaacggcttagagttacaaacctaatttaaccaaaggctagctggaaatcaactcgataagtacagtttatcgagcccttctggctggttcctgttgcccacttagatgccatttggatgcttagtgacttttctacttttagggagattcagttactcccagaacttgctcttgctttttctttggaggtatattatataaaccccctcaggtcagccccttaagcccatccctctgtttgcttcctgctcccatgctgaccccgcaccctgtgattctgattccatcccaggctcagtacatggcgaaagcagtttctcagctcaccatcaaagtgcttcttgcccagtacatgcaaccgtgttttatgccatcttgaccttgcaatttgatgctggtactttctggggttctcagtgacatggggatacaatagtgcacaaaacagatacatatcactgacttcttggacatttatttcatttgcatcagttgcactaatattttgattacattctgaatcatattatccagttgtcagtataagaatttacttaggggctgggcacggttgctcacatctgtaatcccagcactgtgggaggctgaagtggatggattatttgaggccggaagtttgagaccagcctggccaacatggtgaaaactcgtctctactaaaaatacaaaagttagccatacgtggtggtatatgcctgtaatcccagctacttgggaggctgaggtgtgagaatcgcttgaacctgagaggcagagattgcagtgagccaagatgacgccacggcactccagcctggatgacagagtgaggccctgtctcaaaaaaaaaaaaaaaagaaaattaggataatattggaaataactggaaatacccagactactcaacaatgactaaattgtattactgatgatacatcgtgtgttcattaaaaatgtttatggccaggtgcggtggctcacgcctgtaatcccagcactttgggaggctgaggcaggcagatcatgaggtcaggagatcgagaccatcctggctaacatggtgaaactccgtctttactaaaaatacaaaaaattagctgggtgtggtggcgggcgcctgtagtcccagctactcgggaggctgaggcaggagaatggcatgaacccaggaggcagagcttgcattgagccaagatagcaccactgcactccagcctgggcaacagagcgagactctgtctcaaaaaaaaaaaaaagtttatatggtttatattaatagaaaataaagtttgtgtgtgtgtgtgtgtgattgtaagtaagtgacagcaaacaatagggaaagaaagattaaaattctccaactgtgctagaaaaaaagtgcaaataatgtaaaagagtgactttgttctcttcggctcttctttatgttcacatgtgggctgccaactaaatgccccttttgtaaactttggtctgagggttgcttcttattcttttaactgtgtgttgggttaacttcctctatatgcttcaggttgcctaaactttctctatattcttcttttgtaaaaaggaatgaatactcaatatatcccaaagttagggtgaggatgtttttctcaaaaagataccagaagagagggagtggtcttacattaagttcttaaagtgttctgtattagggatcctcttttgattattttgattaacaaagaattctttggagaaaacatatgagcttgaaataactatagataatgtcagtttggaatgcttatggagatcactaaaacagggtaaaaagagggagaaaacaagttgaacacacatttagtaattctttctggggaagtgctctcggaggtgcaggtgttggatgttggataaaccagcttcttaaagatgacttttctaggtcatacatgcagtaagtgatgttcagatcactgctagtgaatggatactgtaggttaggatagaacttccatcacacatttaaaaaattgctgtatctcaaataacttagaactgaagatgcaagataaggagactgtagtcgtagcaaagatccttatgacaaattacacatgaaaatcttgaacaaaatcatttcctgaagtggaagcgaacgaaaacgcatttatttattgttttaatgtattatgtgattttatatatgcaaattaacataataaaatattataaggagccatttgattatttcatccatcctaaaaatttaaatattcaatatggccaataactttttgccccattggaatttatagagtacctaacagttacttagagttgccttatatttaggtatacctgatatctacctggtagggaggtttttaaggattaaatgaaacaattaattgggtgtgtgtgatgtagcaagcattatccatagtaagctctgggttaacagggactgacagagacctgctgtgagatctgcttcctgctcttttttgatctttcctttctatcacaggctgggttaggacacagaaactggtagagagtttcttagaaagtgacaggggaggcctgagaggtgaaaagcatcttgcttggtccctggaagacaggaatctcaaaatgttcattgtgactttctgccactcgaccccttttctctttgttccccctcccccacccttacccccagtgcagtttgcagcacagggaacacacatcacttctgtgctgagagggatcacactcagtaactcaagacaatgagcttagctactttgttcatctgtgaagtagctctaggacaattatagaggtttgcaggtgacttgtaattacctctttattacatgtaatgtttccagcatacaaaccttttatactgtatgtttcccaacgagcttaccgggagggtcgtatgtataccctttataagttaaatttcacttttgaggttttgttttcttttcaaaacagcgtattagagtacagagctctggcgtgactatcattattgacaggttttggcttttcacctctctcctctcggctcacttggatttatttcacataatatcttcttggaattctgattttctctctagattaagcttgaacatttagatgtacctggtaatggagacaacagactaaaatacaaaaactcaatttttataagccttaaattggcattgaatttttttttcaagatctaagaaccagactgaaaaagtattaaattgagctaggaaaactgatttcttgtttactggaacttgttcaatgaaggaaaagttactttacataaggaattattgttaccagttcctccagtaatcttattgtctcctacgtggatcccgtgctttaaaaaaaggtaacaataaaacagaggatgttatgataataaaactcgatatcatgcagtcagtcttgatttgtgaaaaagttgtatttctaaaaatcttatatcaggttgggcaataatagcttgcttgcctgtttatattactttatttgaaattttttagaaataacacattatatcaaataaaaatttattacctatagtttgtcatttccaaactaaactttggaaagcactagtgactttcgagtctggaaatacattgtgcatttgaaattttgttcctgataattagtgagtaatcatttgttcctcccaaaattttgttctaaaatttgtacatggggtttttaaaaattcaggtatggggagacatccagacatggaaatgactgttatgaaagaggtttatgcttacagatccttagacacaggaggctcagtacattgcacgggatcacagggaaacaccaggttgggatgggagccggagatgggagatgggggagcatggcccagagcctttattgtttgtttgtttgtttgttttttcagaagggaacgggcaagacagggtagccaagctgggtaagtttaagattggctagtttgaataattttggcaggctttgggctatagggatggcccccagttgtccaggacctgggcctgggtgatttaggatgggggaatattacctgctgtggctctggattggttggtttgtatatcacaggcacgctcgcacaggggtgttttctgtctctaggaattagccagcccagggaggaacagtctctccacagtcaaggccccaaatacgggagtatcaagaacacagataataagagaatataatcaatacaaacaaaacaaaacaattgaggagttgaagatggcactgctaagcaggtgctgtttttgtgcatgtttttaagagatggtgctgtaaaagactagagaacatgtaagtaatttatttctgagctttacgttttgaaatggtgttttagggggttagtcaaagtaagtgttaactaaagcctaatgcgatatgctatagacatttggaaaacttgaattcagtaacctgacccgtgtaaatttctcccccatgtgaagatggtgggtgggggtgggaggtctgtggtgggtaaggggtgctttcagctttgccccgctagcttatgggatgctcacaattcctcagggctgcttcacttccagctccatcttctgaattccaggcataaggaagagggagaacaaaagggcgcttaccactctttcctccccttggaaggagcggtcttagaaggcttgcccaacaaatccagcttacatctcatagggaattggtgattcacggactggttagtgcttgtatgaagccagcaaaggttgtcctttctgctgttgaaaccaactcaaaaaatagctcttctttgagaggattttgaaaagggaagaagtgggtagttttataaaaaatgtaattctactaaaagtcatagtgattatagtatcagtaataaaaccttgagcttttattctatactggttgctactctgagtgctttatgtatttctatgtacagttcatttagtcctcagaaaaccccattattattcccgtttttttttttcagatggaaattgaggctcacagaggttaaataacttgctcaaggtaacataattggaaagtgacggaatccagattaatagccgagattgtttgctttaaccacgtggttatactgatctgtaatttaaacatctctagctcagagataaggaagctaaagctggaaagttttaaggcattggcccaaggtcatgccggtagtcggcactgagcttctgtttctgggtgtatttccactaccctggtgctgtctctaggtgcacactctcatctatatcctcttatatttgggccaggcttcttgagaggtggatatttttggcttgcgatggttctgaatcctgaaaattatattctttctttagacttcttttacttggcaaggaatccccctggaggcactttagcttaggggtagggagggtggactttagaggcacattgcctgtgtttgaatcgtggttgtgccagcgttagccgtgtgatcttggacaagtcacacacctctcttgagttttagtagtttcatctataaaatgggttaatcatagtagccatcccacagggctgctggtagaaatagatgaattaatacaataaaactgcttagtatagtgcctggcacataagtaaatactttctatcctgcttatattattacttatcagaaacgttctccaaattaaactgaacacatttttcagcaccctgtttggcactcagtaaatgtatatggaatgaataaaagcaactgtgaagtggtttgtattgtcagcccatgcatcctcatactggttggaaatattagggttacagaagattggaatcttcatgttatttttaatatttgtattaatagccattatcactattaagtatcaataatattacaatatcttactcatcttctgctactttccacctcacttcacttttctcatgtataaacctattagtttttacatttggtgcttttatactgagactgtgttgaaagacattgtatacatacaaggtactgtaagtgatataaaagtttatggcttcatatttaaaaatggatgttactggttttgagtcttctcatgtcacatttccaagtaacagcaatcacccattaaatattaatttaatcacaggaacaagatacaatcgtcactaaaatgactttaaatggtagcatcactaagcagtgagataaggactggcaaagcaggatttgtgtcattctgtggcagcttttaaacaatgtgtttgcatttcccttgtccgttaaaataatacaagaattaaacccttttaaagagaacctacccatctctttcccatgtgtcattcttgcatcagagaaaatgctgcataatactaagatgacagccccacctctgatgtcacccaggatggtacaatcctctccaagcctttgctgggcttcctgctgctgcactgggggacatggttacattaaagctaactcccgtcatctcaattatctccttggaagtagttttcacaaatataaaaacgccctacggtggctgttttcggtaagctaccaaggtagagagcggcagaggcagacagggagagcaaacgggagaacaggctgcttccgcctttgtgagagggactgaggcagcagctcctctcggctcgggttccaagtgctcaaagtgcttccatttccatcaccgtgtgcagtgcagggcaaaaggggctgccaggaaatctgaaactaatttgcttccagttgactagaacagcatattttgaattagcttgcttctttttaagctaacttttctcaagcgttaaactgatgaactgggcattttctatgatcaatgggtaactgctggagctacagtaatctctgtgagtaacctctatttgtaggtctatgcaggcaaatatatttttatatatctatttcttttaaatgctgctgtgaaagtatccgtctgtattattgactgcttttgcttactagtcttgtctttcgagcgtcccagtaggagacccctggggctagaccaggttctgctgaatccagacatagaggagagcattttgcatttattcggggatgcccgcgccaaccattctttaattcccagtcatcagagagatgccggctgccctctgaatgcctatgcccagcacctcacctggctttacctggaatgttgatttcagcatgtgacattgagtttttcaaaatttttatttttatatagaaagcaaaatattattcttacctgtaatcttacttcttttcttttttttttccccacaagctttcctgggaacacacaattctgtcaccctatgtctgctccctgtttgtgatatattatatagacagaaagagagaaaacaggctacccctccagttttagaaagacataatgttgtagtgctggatgggaataggggaggagtttctcttaaagagctcaaactgctttccatctgtgtgcctgaagtacagcttagtatctgaatagccttgaagggaacaaggttagctcaaaggtagcaccaaaaatgttctggaaacacgctagttgaggctgagatagaatctttactggaagtttgtaacaggtatctcagtttacacacaaggatgtgtttttcctgtttgttaaaagtgtcgcttttatagtaattcaagatttatttctctctcaccatggaaactgactttcaactctctgcaaaatttgcatttctagatatacttgggacaattgtttatgtcagattgtagcctgaatccttagtgaaactgtgggtctcttattgagcatgaaaactactggctgcaaatgtggatcagctgagtcctgagtctgctacacactggaggctgagtgaggtggcgtgtttaccactgcacctaacatctgtcttcatagacagaagtttaaagaagtccacagctgtagttgatcatcactgtgaagaactccagctgcttggcattcatgattattttttaaaagaattgtatggttttttgaaacatcaaattcttaaatgtcccaatatttcctacatatatacgaaacagtttatattaatcttaccatatatgtgttaattttagcagaagaaagcttgctgtgagcgagactgtggggttatttaaaagtttagtttaaacttttttttgtcttttaaaaataaaattaaaactaaagagtcagtaaagagagaaattttacaattggatttttaaaagtatggattccccaacagaaaggatcgtagaaagtggacagaatggatgaaatcagaggggcatccctgatcagaaggtaaaaggctgaaaggagaagcacaagatgtggatataaaaaaccagaagttatgacaaagagaggcagacaagagtggagaaccccactggttgaaaaaggaaaccagctttgaaaaacggcaattttaaagatgagctcaaattcagctcttacagcttagtgtttcttctctgtaacaggtaacagtgctctgcacagttgcagagactacggtttaaaattaatgggctgttccctgtctcactcaagcttccctttggtatgctgtatgcggtgccactccttagctcacagagctgcctctgaaattgactgaatggtaaactagtatcatttctctagggattagagctgaataagaaaaattgggttctgaatcattagtatgtgaaatttagtttgccgtaagcacagctgtaactattaatcacttggggaaagagtgtccaattaatggaatattttctgttcgtgtgcacacgttagaagcttgtgtagtggttggcaggtcttttcctgtttttttttatttttttcctaacacataaacaacttaaatatctgtgcctttagcattatcagtgtccaggcaatagccagcatcctggattacataccgtagttttcttcaaaatgtgacttttcttagggtgaagagagtgtcttaaaatataatgtatttagattactcatttagtaattctcattactcatattcatttttccgttatttttatcataccaaatttattttctattgctgggcaaaatgggttagattatcctcttgttttattttaatacaaattttactattgcattgcaaatttgagtcatgtatcactgtgttgctggtgaagtttattgattattaaacgtaaaaatgttgataattattacagttaaggattatagttacttataaatgaaatgcatttgagattttttttttaactctgcaaggcttgctctttatatttgttttgtaaattaagcatttatcttccaatcttacagatttatgaaatttcacactaagggatcagagtggtcactctttttcctgccctcgtctttggaactgaattcctttctgacaagtgaggggaatgtgattttaagcttgcttctataaattttcaagtgttaaaatagcttactaatttatagttttcttgtactaacataatattaatatgttttaaggtgtttactaactggtattcattagggaacagagaacaccaaagatgttattgcatttatgaatatcacatgtagaaaggagggaaaacagattattagtggctgggttagccataatttataaaggattgaaaatccgatgaactatagtcataggaaatagattataagacccttagtgcattctccatagtatcttatcagactgaatttccccgtacatttctattttaaaagcaacgcatccaaagatatgaacattaaaaaccttgggaaaatattctggtttttaaaaattggaaagtccttacccttccctgagcccatttctttaagctccaaagtaatttttttaaggctgtgtacaaataataatatacaggttttgactaatggtcaagtttacatttgcagttattttaggatctttttgtgtaagtagagagtcattggccattcattgtgagagaaatttactatgagctgtaaaatcaagaaggggtcatattacagcagaggcaattctcttcctctcttggaaagggaccggggttacttggtaatttgagggtaaacccagaccagaatgatcaagtgtttctctttgcagtaatgagattgttttcttggaacttactttagttgatgtctatttgattgaacagttggacctctgagttaggaggcaggcagttatgatctcttttaaaataaaaaagtaggcattaaatgtaatcagaatgacttgtagatattgttgtagttttctggaggtgtgtttctcatcctgtaacgtgtatacaaatcctctgggattctcgttagaaaccaacaggattctgattgggaatgtctgaggtggtgcctgagagtctgaatttctaacaagcctccttggtgatatctatgctgctttctcaagaccacactgagtagaaaggctctagggcagcactttcaaatagagctttctgtgatgacggaaatgttctctgtgtatagacagatacagaaatatacaggtatctatacagacatacatactccactatacagatatatggatatctgtgtgtgtgtgcgtgcgtgtgtgtgtgtgtgtgtatatatatctacataagctatatatatgtatatatatatccatatatctgtatagtggagtatggtaggtattagctatatatggtatggagcactaaggaactacaatttcaattttattaaattttaagtaacttaaatgtaaatgtaaataggcttctgtggatatggctaccaaattggacaacacagtgttagagagaaatccattgagaaatttatacttaatggtatcagctcatgtaggatcatgctgaattctagaataggctgagattatctccactgaaatttaccactgcctgaactttgtttgcgagcagacagtatatatagatggagctgctggattgtaagctccttgatgacagaggccaagttgctcttgtttgttgcccttttctctgctgcttgatgcattcatggtccacaagaaatgttggctgagtaaatgagagaatgaactggctctaatatcaggaagcgccctactgtttcctgaatccttttcaagcctggacttagaagcaacgggtaggacttgggtgacactaacatatagtgttttgcttatgtttaaggaggctgcttttttgcttctgtcttaaggttttttgtttgtttgtttgtttgtttgttgagacagaatcttgctgtgttgtcccggctagagggcagtggcacaatcacagttcactgcagcctcaacctcccaggctcaagcagtcctctcacctcagcctcccaagtagctgggagcacaggcacacaccaccacacctggctaagtttttaaattttttgtagaggaggggtctccctgtttgcccaggatggtcttgaactcctgagctcaagtgaacctcctgcctcaagctcccaaagggttgggattacaggcgtgagccacctcatctggctttcaccttctattaattggtatcctattggttctgggacattcataattgattgcttcaacaaaaatacccattttgctaggtaaaattgttataggctctggagatataattgtaaagaaagcaaataaagttcttgccttttagagtttatatttttgtggcaacaaaacaatacaagacaaaacaaaaaccttttactaaaaaatggcatgactgatcccaggttctagaaaatatatgtgtgtagaatccgtaactgtggctctcctgaggaacctaggcatagatgtgactgccatatagtctggggaaacgtatgtcctgttgctgagaatcccgcatgaaaacggttttatctggttcaaatttcagcttacagtgaccgagtctacggtagatgtggcaaatagttcttatattttgtttttcttgaactattgtcttttcaggagtttgctagccagagtggaagaaaaccagtttgatttactgctcctcaaacaggataattcttagaaagaccctggtttttctgcagccgatcttatggaacaggcttattttctcacaatttgaagaaatttctttctatttcatttcattttattacagctctgtccctgtgttccagaaacagatgactacttaatatataacccaaagcactcctaaaattcatcttaacattcaaatgtatctcatttctttctcaatatactaaatcaaaagaaaaaaggtctttaaaaaatcagtgggtttatatgtcattgcaggaaaagcatctttgctaaacaacaggaaacacgatttgttaggaatctaaccagatacacaaagccgcagataaagtctctgatagaaaagtatgacttctaatggactgtaaatagatacctccaaaaagtacctgtatttcacatgaatgtgaaaactcttctctcttccctcctccacactctacactacattttcatttctttaaggggaaaaatacacgcagtaaagtatgaactctttattaattcacattctactagtgtgtggtttatatttaggtaagtgctaaagttctttttttatatttaacaagtccctgagtccctttgtcacacatacaagaccaaattcaggtaggactaattcaggaaggctcgctggaggggaaatgttttcagtggattcttacattagtaatagatgtagactgaaagggaaagtgttaacaagtttcaagtttggtgtaagagctcacagcagttggaagaagccatgttgaaactagaggggcctggggcagaggagatgaggagatgatgggcatggatgccggtccaagtagagtgtcgtgggagatgcagcaccccttgcatctttgttcctgtctattctgcctttgttctggctctagcactcaccgtctctcacctgtactattgtcagaagcctgcgtggttattcctgagtctatgcttgtgccctctctgctacacatccttcacattccaccaaggcgagctttctaacatgccaaacagacttttcatgttctggaaatactcagttttgaatcccctgtgtttagtacatagcaggtaatcaatatttgctgaatgcgtgaatgaattttggaaacaatgggcatttaataggaagtatctaaggccctattttacaagggagcagcttaaaaaatcttaaaacaataatttggtctttttttaaaaaaataattatcttagcatatagtcccaatttttaaacagaaggaataaatcagaaattctaaataaaaggtcaggattaacaacacagtcaagttgtgataaccaatgcaaacagcaaaaataaactgctcatggggtgtggcagagggtgccttatttgaaaggaaattcttgctgttatgctgaatccttagggacatgataattaaggctgtttctacccagaagctacaactagaacacttctggttttattcttcattatatttgttaacattactgctcttagcaatgatggtcttggctaaatgcgttagttcacgccgtaatcccagcactttgggaggccaagggtgggaggatcacttgagcccaggagttcgagaccagtctgggcaacatagggaaaccccgtctctacaaaaaaataaaaataaaaaaattagccgggtgagatggcacatgcctgtggttccagctactccagaggctgaggctggaggatcacttaagcaccggaggaggctgagctgcagtgagctatgatggtgccactgcaccccagctgggtgtcagagtgagaccctatctcagaaaagaaaaaaaaagcaatgatgaatgatgatctctcacggttcagtgtccctgagtttctcccaggcttttactcctgagagacagaagactagaaatttagtcctgacttagagttctaaaacaatactttattgaacatcattttattgaccttggtcaggtcctttcgcctctcagaacatttgtctccccccgtctgttccagttcttagaacagtaaacacagaccacgagaaactactccagtatttaatagtaaagcaagcaatctgtcacgcagggctttgccttgccctgtctccctcttatctgacctcgttttctttgaccggttgccaagttgttatatcagacatcacaagcacttgcccacaattgttgaatttgctgcccctttctgagggacatttcaatgaaaactattaaaaatggggtgaaggaattatcagaattctctgaggccccttgatatcttttggtcacttctcttggggccagtgttcagttgtgtgtgcgtgtgtgtgtgtgtgtgtgtgtgtgtgtgtgtgtgtttgtgtgtgtgtgtttgtttgtttgttttttccagagggcagttgaaactgttaaagcaaagcgggctcccaagtgtctaagtttaacttttcttccctttgttgaatggatttcactgttatatgttttggtgcagtttataaatacagcttcagcagtcactatggtcaattttcttaaaacacttcatgatgggttaaacattattgcctttggaagctttaaggcgtgagtaacattatgcttatttgttttgtatatttacactatatataccataccgcaaaagtctttttgacatttatttatacagaggagaggacttttttcaagagttggtgagcaagggaaggcttaattaaggacaggggatttggtttaggtgttgaaatgtgaaaataatctgatttatgttgaaatgagaagaaaaagtatgtcaggtagagaaaggaagttgaacaaaggcaaaggagcgtgtgtatgtctatgcattcagaatgtatgtatgcttaagcttatttccagtgtgtattaggattagaacaaatcttttcagggtattcatgggctgcctcctacttcagtgtagaggcaatggtataacatgtgaaagggggttgacagagacttgattagaaagatggattgggattgtaaaggaagaagtaaagcttttatccacagatgacatgatctggtatgtagaatcctgaggaatctacaaatatgttattatatgctccaagttaagcaaggttgtaggatataagattcacatacagcaacaaattgaatttctatgcatggctactgaatgatctaaagaaatttgaaaagcaatatcaaaagaaatagaatcttaggggaataaattgaaaatctgtacatttaaaattataaaaaaaaatggctaaaagaaattaaagaagattaagtaagtgaaaagacagcccatggtcatggaacgaaagatgtaatagtaatactgttaagaagccagtactgtatagattcattgcagcccctatcaaaatcacagctttctgacgagttgattctaaaagtaatgggaaattcaaggggccaagagtgaccaaaacaacctgaaaaaggaagaacaaggttggaggagactcacacttccagatttcacttactgcaaagctacaatagtgaagacagtgttattctggcataaagataggcatctagccaggtgtggtgctacatgcctgtaatcctgacactggaaggctgaggcgggagggatcacttgagcctaggagttcaagaccagcctgggcaatgtagtgagaccctgtctcttaaaaaaaatgaaaaattgtccaggcatggtggtgcatgcgtatagccccagctactcggaagtctgaggtgggaggatcgcttgagtccaggaggtcaacactgcagtgaactgtgattgcaccaccgtactccagccagggcgacagagtgagatcctgtcaaaaagaaaaaaaaaaaaaaaagataggcatctagctcaatggacttgagagtccagaaataaacctttgcatatatattaatatatgtatatgtttgatttttgacatgggcaccaaggctttttgatgggtaaagaatagtcttttcaacagatagctctgggacaactggatatccacatacaaaataatgaagttggatttctacttcacatcatgtacgaaaatgaattgaaagtggatgagagagctaaatgtaatagcaaatactgcaaaactcttagaagacaacgtaaaagtaatctttgtgacgttggtttagacaatgatttgctacatatgatacaaaaagcacaagagaccaaaggaaaaacggataatttggatttcagcaaaagtaaaaacgtttgtgcttcagaagacactgtcaattaagtgaaaaatgaccactcacagaatggtagaaaacatttgcaaagtgtacatctaataaagaacttatgtccagaatatataaagaactcttagaactcagtaataaaaagacaaataattcagccatcaaatgggcatgtctctaaaaaagatgcacaaatggccaaaaaacacatgacaaggtgctcaacataattagtcattagggaaatgcaaatgagaatcacagtgagataccacttctaggatgtctgtaacaataaacagacaataatagaatcttagacattgcttgtaggaatgtaaatagtgcatttgctttggaaaactgttcagcagtttcttaaaatattagacataggtttactatatgatccagaaatttcactcctaggtatatatagaagagaataacaaatatatttaggccagatgcggtggttcatgtctgtaatgccagcgctttaggaggccgaggcaggcgtatcctttgagcccaggagttcaagactagcctgggcaacatggtggaaccccatctctgccaaaagaaaaaaaaagaaaaattagctgggcatggtggtgcatgcctgtgcctatagtcccagctactcaggaggctgaggtgggagaatggcttgagcccaggaggtcagggctgcagtgagccatgatcgtcccactgcactccagcctgggtgacagagtgagaccctgtctcaaaaaaaggaagaaaagaaaaaatgtatttagaccctgaaacttatatacacattttttattcatagcagccaacaagttgaaacaactccaatatctcatcaactgatgaatggccaaagaaaagactgctcccgtatgatgaaacattatttggcaataataaagaatgaagttctcagccaggctcagtggcgcatacctgtagtccagctacttgggaggctgaactgggaggtttgcttgagatcaggagtttgagaccagcctgggaaccatagagagaccctgtctctctttacatgtaaaaaataataaaataaaaggaatgaagttttgatagatgatatgacatgagtacacctgacaaccttgtgccaggtgaaagaagtcagaccccaaatgccatatattgtatgattgcatttatatgaagtgtccaggatagaccatttcatagagatagaaagtatattggtagttaccaggggctgagaaaagctgaaatggggattggctgcttatggatacagggtttctttttgggagtgataaaaatgttctggaatggccaggcgccatggctcacgcctgtaatcccagcactttgggaggcctaggcgggcggatcacaaggtcaggagatcgagaccatcctggctaacactgtgaaaccccgtctctactaaaaaaatacaaaaaattagccaggcatggtgatgggcacctgtatcccagctcctcgggaggctgaggcaggagaatggcgtgtatccaggaggcggagcttgcagtgagccgagatcgcgccactgcactccagcctgggtgacggagcaagactccatctcaaaaaaaaaaaaagttctagaattagatagtggtgatagttgtacagttttgtgaatatactaaaaatgcctgaatcttaaaaggtggaaccatgaaaagacctactgccttctttactgaaagacataaaatatcaatattccaccctaggaagaaggctctttattgtttttagctatcatctttttcaattcattgtttgaaaagtcacttcctcttcagatgtaagcaagctacattttattagttctgtcttgtagaaggtgttataaatactatcccagagaagtgcttgttagattccatcaacacttgattcagatttaattttaagaatatatttcaggccaggcatggtggctcatgtgtgtaatcccaaggtcaaggcgagaggatcatttgaggccaggagtttgaaaccagcctgggcaacacagtgagaccccatctctacaaaaagtaaaaacgttagctggacatgatggtgcatgcctgttgtggtcccagctacccgagaggctggagtgagaggatcacttgagccgaggagttcgaggctgcggtgagctatgttcgcactcccacactccagtctggatgatagagtaagatcctgtctttaaaaaagagaaaaaagtgtatatatttcaaattattttacaacatggaatatgaaacagcatgtactctcagaggtattgctatttaacacactgggggataccgtgtgttcaatagcaatacacctattattagtaattgtatcagtaattaataattatcagttattaggataactgatgtttccaagttaccttggaaatcaaatttttttttttttttttttttttgagatggagtcttgctctgtcacccaggctggactacaatggtgcaatctcggctcactgcaacctctgcctcccaggttcaaatgattctcgtgcctcagcctcccaagtagctgggattacaggcagaatcaagtcttttcagccatttcagtgtatatatatacacagacatttataaaatatttcactaaataggaaggttgtagctctgcagtagtttaaaaatggtaacaatggccaggtgcgatggctcatgactgtaatcccagcattttgggaggccgaggcaggtggatcacgaggtcaagacatcgagaccatcctggccaacatgatgaaaccccgtctctacttaaaacaaaaaacaaaaattagctgggcatggtggcacgcacctgtagtcccagctactctggagactggggcagaagaatcacttgaacccgggaggtagaggttgcagtgaaccgagatcgtaccactacactccagcctggaaacagagtgagactccatctcaataaataaataaaataaaataaaataaaataaaaatggtaacaactaatgtcctctttcataaagtaaaagtgagtacactgtatttccagcatagatgagggttttcatgatacaaagtaaccaaaactaagttcagaagaagactggatactagggctgataggactacagctgctatctgtaaacccccaattgaaagttttggtttgtcagaatgtccccattttcagttctcactggctatcattttaacaagaaaatattataaatttggttcaatatagtgaatatatactaatactgtttacttcgtgtattggggttcttcgtaagatgccattacaattttatgcaggtagtgatcttactaatatgtagaatctaaaatgttgagctcttggaagcagaaactagaatgatggttaccagggactggtgggtggtgggattggggaggtgctggtcaaaggatacaaaattgcagataggtaggaggaataaattcaggaggtctgttgtagaacatggtgactatagttaataacaatgtattgtatacttgaaaattgctagaagagtaagtagattttaaatgttttcactacacaccaaaaatttgaggtacagtactggtatgttgttaattagcttgatttagctagtctacaaaggtacgcatatattaaacattatgttgtatactatatatatataaactttatatatgtaaacatatatctagatatataaacaaacttttgtcaattgggaaaataaatgaataaaatgagaaaaatgaattttccgtagttgggttcctggaagtctttctcaacacactaagtttctcattccatgttggcttcattcttatttttcagggatgttttgaaagcattttttccctccacagaaacccaacaatgaaggggagacttctggcagaaaaaacatattgactgagtttaaatagatcataagcattttgcagaggctctgtctcggagcttgcactgcacagatactgttggctagatcatagggctctttagtgttaagcccaatatacacattttagttgctgtttcatgagtggtatttggaagttggtacatatccttattgtaacccctttttgcatatgaagcaactgaggttctgaatcctcatgtatgggacatcagaagcaaagttaaatatggcaggtgtcattagattgccttctaggccgaaagttttgtggttatactcgcgtaggctgagtagaagggatcactgtagtgtcatgaggagtgtgtgttacagggtggtgggaggactgatataatgcaataatcaagttaataagtattattgagtgcctaatctgtgtgaatatgcattattacctactgggccctgtctttctacaacaagtcatatgtccattgtgttctcttcacaggtgatcatggaggaagcactttactcccaccaaatgtcacaaatgaatttccagaatatgggaccatggaggaaggtggagaaggcctaagggcttctctggaatttgatggtgaggctctgccatgccacccacaagagcagcagggtgtccagcctcttactggctgccactctgggctcgacagtgttacagaaggaccaaaagatgtcagagaggccccctctcaaagtcatctcaaggaacaaagtttacagcccattgactctttgatttcagctctgaaagccacagaagccagaatcatttccggaacattacaggctacaaaggtactggaccaagatgctgtttctagtttttcagttcagcaggtggaaaaagagctggacactgccagtcgtaaaacacagagagtcaacaaaacgctccctgctggccaaaaaaatttaccagaaatacctctttcagctgaagtaacaacggaggaaagtttttatttgagcatccagaaagatctcaccgcgctgttaactggagacactcaggcagagatttcccagataatgaataatgggaggaaaggggctgtctgtgtgcaggagccatcttgtcctttggcctccctcgggagctcagcagtgacctgccactctgcaggcagtgttggtttcttgaaagagcagaggtctgctcttgggagagagcacccagggggatgtgatcgaagcagctccatgggacgcccaggccgggtcaaacatgtggaatttcaaggagtggaaatactgtggacaggaggagacaagagagagacccagcatcctatagattttgagacatcactgcaaagaacagcctctcctgacagcaaagagtcttccaaagtgccacgccatctcatctcatcagctggtttgtgtaattcaagtagtttaactgagaatgtttgggatgaatcctggaaagctccttcagagaggcctggcactagctcggggacattttcccctgtgcgtcttgatgagagtggagaggatgaagtcttcctacaggaaaacaaacagcatcttgagaagacacctaaaccagagagagacagggaaaggtgagctcccatagtagccctgctgtctcagatgcctggtacatatcatagaaaactgttatcctgtacttgatatgagaactcaatcacaataccttgggttcttgttatcatggaatataagatgagttactgtgagctaggtccttctaagctaagattcctcctaagcttctcagatattaaagtgatcttgttataaagtcatccgttaggcatggaccagggaaacagagttctgaagagactgtgaacactaaactgtgaattcttttctgacattttcttaacatttgacagatttcaagtttcccaacgtcaaggtaactaacataccccacagtcatctttagtaatatgaaaaggtttggactcttttgacacaccctatatagctggtacttccaaccttggcatttcttctgggtataacaccaatgccttcagtccagccgacatacatgtatgaacacagaggttcttggcccactcaatttcctatgtttgtttgtttatttatttatacagagacagggtcttgttctgtcccccgggccggagtatggtggtgtgatcacggctcactgcggccttgaccttccaggctcaagagatcctcccacctcagccctctgagtagctgggactacaggtgtgcaccaccacacctggccaacttttgtactctttgtagagatggggtcccactttgttgcccaggctgtttcaaactcctcgcatcaagtgatcctcccaccttggcctccctaagtggtgggattacaggtgtgagccactgtgccgggcccttcctatgttttgaaatgacatctcagggggtcagaagtagattttataattcagttgttccctggtattcacatgggaatttcttcttctcacaagtagcatatattttgatttatggccttttttttttttgtaaattatactttaggttctggggtacatgtgcagaacgtgcaggtttgttacataagtatacatgtgccatggtggtttgctgcacccatcaacccgtcatctacattaggtatttctcctaatgccatccctcccttagcccccaacaccccgacagggcccggtgggtgatattcccctccctgtgcccatatgttctcattgtttaactcctacttatgagatttatggcctttatgattgaaacttgacatcatgtggtatttcctggtctttccctgcatttctgacatctacaccagcttagaccctggataaatggcagacgtgacccatctttctgcactccctttgatcgtagtcatttgttgtgtactgtacttctaattggtaccatcttttcttctgtcagccctcatgacaccacattttatagtttatacgggagagcatctgtgtcaaggccgagggttgttttttgtttttttgttcggtgtaaggaaatgccttttcctctgcagttaaaaaacccactgagagtggtgctcctttgggatcactggcaggatccttcccactcccctccccaacccatcagctctccagacttccctccaaagcggccttgatatgtggcatgtggcccagtgtttatattcccactggaatatgcacttttactgttgttcagattaataattcattcctcttttcttcccacaaatattttcaattgtctcctatgtcctgacactgcaagatgctgggcgtaaaggaatggtcaaaatagatgtggctcacggatactgtcctcatggaatttaccactgaagataaacattgatcacataaacatgctaataggtataggatcacaaagtgtgctaggttctgtgaaggaaagaacagagacctacaagaatgaataatttggatggagggaagaggccagtttagttgatggcttggacaaagcttttctgtggaaatggaaattacactgagacgtgaggaaggaaagagtttgccagccagagaaggggtaggaagaatgttccagctagagggaacagcatgtgcacaggaggctgctgagctccctgactagtgtgtgcttcctgcagatgtgtgaagccaaggcctgtgccaggcttgaagatttgaaactctccctgtgtggctaatgcctgaagagcaggggaggcttggcatggtggctcacacctgtaatcccagcactttgggaggccgaggcaggcagatcacccgaggtcaggagtttgagaccagcctggctaactccatctccaataaaaatacaaaattagccaggcgttgtgttacatgcctgtaatcccagctgcttgagagtctgaggcaggagagtcacttgaacctgggaggcggaggctgcagtgagccgagattgcaccaatgcaccccagcctaggtgatagagttagactgcatctcaaaaaaaaaaaaaaaaagcaggggagagtggggtgcagtgagtgtggagaggtagggaggagcatcatcttaggaacggtccagtttatgccaagtgcagtggaaagccattaagaacaagcatttggtcccatgggtgaccttcagtatttaaaaacaacaaaccaattgcaatgctgaatgtggattccagtaatacctgggaatgtggatgacttatgagatgcttaatagataattcctaattctatgttattcctatttgtaggaatctgaggctcagagaggttaagtaaagttgcttcaagtgatatagctagtaattgagacagccaaaattcagcttctggtttttctaactcttgacctcttgctcttagtagtgatctatctcccaagtttttaattttacttagttatcctaatgttcgtttttaatatttgtagaacatgctgcatattaattgttcacgtttgtgtgccaaagtgaatgccctaccctgtatgttgacttttgagctgtttctaatctctcaaagctttggttagccttgcttctgttgcctttttgttaggccgttaattggctatctaattttggacgtgaaatctctctgcagtgctgctctgttgtcagcagggggcagctcttggcttctgatgcagtcatctgcttgagagcatttggccttatttaaatcagaaagtattaatcaactgatgaaagtttggtgtatttttactgaaattttgccgtatcaagtttccatgatatatttatctgcttctgttataattaggaatgctggtagttgcaaataatctgaatgtgtacggtatatttggctaaaatgagaattgaatattttattcatatcttcattggaccagatgtattcacacattaggaaactagtttgaaactttattaaagtatttatagtgtcctagccacatgcatgccaagaatttttcaacctgattatatttcatagcttccttcccaaatatgttaagatataagtcaatgaatagaagagttagatcttcagaatgttgtcctttttatatggttgaagtgggagaaataaagacattaacctaatattggaattcttcactcttatttactttccaggatcagcgaacaagaggagcacgttaagggggaagatgaagacatccttgggcctggatatacggaggactccaccgacgtgtacagctcccagtttgaaaccattttggacaacacttctttatactacagtgcagagtccctggagacattatactcagagcctgatagctattttagctttgaaatgcccctcactccaatgatacaacagcgcattaaagaaggtggtcagttcttggagaggacatcagggggaggacatcaggatatcctgagtgtgtctgcagatggtggcatcgtgatgggctattctagtggcgtcaccaatgggctgaatgatgccagcgactccatctacacgaaaggcaccccggagattgctttctggggaaggtactcgtcccattctcattcatttcatgctggtggtttttgtaggatttcttttctgggaaatctgagtgtggaatatatatttaaatcatttggccaatttctgtggacataagcaaatgatgtgagtaaaaagtaatttgagttttagggcaggaaagacacaccttagtggtttgtcacattggcacactgtgatcattttagtctgtgggatttcctggatgactatatataaattggataccaaacaaatatttggggatgatgagtgaggttatcagctccgatgatggcagagacgtggtgctgtgaaacgaacactgagagatcgtagctttagtctggcactgagggtggttgaagacttcaagaagattgtttgattagctcagagattccttcattggaaattaaagtggtggactatacagtcagcaaagtctcttccagccctttgctctgagagttcctgttctgtcttcctgttcctgacgtgttgaaggaaggatccgattagacagatgcttgagagagctgatatcttggtctaggctccgtatttattttctctctctactttaggatttttaatctatctgggagataaaatgacaaattatgtacattgtatccaccatgcctgttatttggggattccgcgactatttatggattatccagcgtttcatttcttcatgctcgtcatcctcaggttatctacctgtgacaattttatgaattttgttttggtatatgtgtgtgtgtgtgtgtgtgtgtatgtatgtatgtttgtgtggagctggtgggaggtgttaaatggtgatcaactattttaaagctgtttaaagctgtattaaataataccagtgttttttgttaaaaaaaaaaaaagccagtattaatattacaggttttcaatggacctctctttttgagcagtctgccctgtgctgagcattttctataaccagtttgaaggtttatagttcattagatgagcaaattcaggattggctccttgtgacattgtagctatgcattttcttgtgaatatggattgtggatattggttgtcttactgggtcacagtgagaataaaaagaacaaggtgtcaaaaccacaagactttggtctgaagtacttgggcaagccacttacgttctctgaaactggatttatttatttgcgaaatggggttaatgatccagtgtgttgtgaggctgtgagatttaaagggttaatagagactaaagcacctcgcacaggacatggtacaaagcagagcctgggtaagtgtgtgcatatgaactggttgcctggttagtccacatctagacttcttgtatctctgagatcagagtgtctctcagtggaagagtactggcgaggaggcattcctgaaagcagtgtccccgtgaggcggtgctcctcagtggagggtgccaccttagtcctcccctttcaccttcgtctctgaggactgcaaattgtgataaaacgctgtaggaaaggtatgcagataattgcactgaaattcccactcagttttctagggtgagtggaagttgtttatattacagaccaaacatggtttggggagtggaagagttttgggctaagaggcttcactgcaaaagccacagggagtggttgtaagtgaagccgagagatgaacaccagtgaaggaactgggtgaaaggtttattaaatgtgcggcttgtgcacttagaacaggaggttgtcatcatttgggccagcatgggtgccagtcacgaggatggacagagttgggagagaatattagagtaggtcatagtattttagcatctcatatttagacagtggtattcttcaggccgtgttgagataaagtttcagctgtgtcacctgcattgtcaaaccaggagatcttgtctagtggtaaaggaccacgttctagtggtgagtgacaagcaccttggagacgcgccagcttgcctctccccgagtctgggcactcctactgtacaattcctgattggtggtcatcctaccatgtgctgagcactgccagtggcttggacagacaagcttggcaggactcccccattttgtgttatttgaggttggcatatgataataagtggttacaggtggaggaagctttattttgtgatgtatgtctctattcaaggttaaaaggtagggcaggtttaatgatcctaagaaattttaaggaaactgaaaaacccatatttttctttactcccttctaccttccttgctgatttggagaagttgtaaccaaagaagaattgtgttactattgtgggttagagaatgagaacattttactacttgaaggggcctcagatagcctttaaaaaaaaaaaaaaaaaaaaaaatatatatatatatatatatatatatatatatatatatatatatatatatatatatatatataacatagaatctgtattccagtttggtgggatatcttacccaaagccacgtggctgtcttgtgacagataccgtagtagaattcaagttgtctggctcctaggccggattcattcactgtgctaggtgttgggtcttttattttgttattcttcttttgatcggatttctctcatgccatgtgttgataaagccggaagtctgagatggtctgttttcaagaaactaagttctaaatgtagagctgcttgttgttgttgtcggtggtggtgtatgcattcaatttgaaggaaaatttaccaggtcaataatacacacgtttccacacatttttaaagcaatcagtgagctggccttttaaaatttcatctgcgttaaaacatccctctgccgaggcaaggaagtggacattgaggtattaagcctgtccttcagccaagcactgagggcccaagtgttagaattaaaggaaaaaaaatttcccattgtattaatatatttacaaaagaaaagtcataaataaaagcagtggccatgcctccattccatctgtgttcactcgcctctcctgcttccttgctagtggtgggggtctgagtacattgcataaagtgagctctgaggaaggcttaaaagaaaaggaataagactaatgaattctcccctgatcgcgcctccttgatatttggtagacatgaaccaaggaaattaaatattgattttaatgtataaagtgttagtcgctagcttgtaaaaaatattattactttagctagtctctgaacataattgtgtgtcatatgtggcccataggtttgatttatttagtaaacacatgatgcttcgttctcataatgagctatagggggaagaaaggaactattagtgttctaattttccgaataaggaaactgaggtacagagaggttgagtaacttgctaaaggtcacacagatggtaagtggcatactcagccctcgaacacaggcagtcagcctccagagcccgtgctcttactgagctatgctgaactggaccaagtggtaatgatttcatggtagatctagaacaagaccagatatcttcaacaaaacaaaaatgtatttgctttgctattgcctagatttacttaaatccttttctgtttcaagatctgtctttactttgtcattaaagattatttcagtggcggtattggacagtgattttttttttgagcacaggatgacactgttctcggctgaattgctcttttaaagaaaggtgcaagaggttgggaaggctgattgtggtgttgtagcacttagttccttctctcaggaatgccttccagtcttgggctcagccatcctttggcggccagagggacactgttcttccctgttactctctctactcaagtcaaagaagaaaatattccaaatctataatattctagtatgcagttgggaaagacagttttttttttgagtgcgtgtctatttgtctttaaaagtattaaatacctttgtgacatcaagcggctcactctgtgtaaggtgaaaagcctcttaaaatcctggaataaatctggatggactattagattgtcacaaacataattaagttttttgtcattactttcaatggcaatactgcaattacttttgcaccagcctaatgcattctcccaggtgcttgctctgcctgcctgttgatgagtgagccacatgtcagccggaaacagctcagcctctgcatggaacacaatatatcaatgaagaagcaaagaggagcatcccctccccatgtagcccagctacatggccctcaggctgaccgggggtcagcggtgctgtgtgaagtcctgtcacatggctccaaaattagaaaggataattagagacttacaattatacacgtttcaatgggttcctttgtgtctgagtgcttctcgctcgccggcttatcagcagatgaccacaacttcaatcagtaagttcttaaggcacaagtgttgtcactgtgaccattagctggatattgtccatttccattgaacttgggtttggacaggagaaaaagaaatagcaaataccgtgacatggcaggaacttcttttttggttctttggaatatatgaagctgctttttgaaataacctttgtagcgtgatgatctattttatatctaagcttccaagttttcctttcagatcttgctcgggatactaacgggtatggcagaacaggtgaattacatctgcgtgcagctgatctgcctgagggaagcgcttcagtctgtcttcagcccactctgaatttgatatttgtggggatttttttttttttttttgccttgctcttatttctttctcctccttctcaaatggaatgcagtgtttggaaattattctctttcttcctcagtttttctctatctgtattgtttgtccgcttaggaagaattcatgtgaaataagaagtagaaatttgttgaagtgcgatttgaaaaactgtttcaacatcccagtttaaacttgaagtcactttaatataatatataaatattaaaagaataatttaaaataatgtgacattagtgaagctggtgacagagaacaacattttcatgttgtgaaattggagagatctggctgcccacggagctccgggcttcttttctgccattggtgctgggaaggtctgctgccttgtggcttcatgagcctgttgctgttgctccagtaatctctttaatccttttcttttacattttaaatttgttcagtcaaaaaagaggttctcatttttctctttctggcttctttccaaagtagtgtaatggtgatttgattttttttttttaaaaaccacaaaggagttcctgctcagtgatgtgggttaggggctcttctaggtctcagagccatttattcctggtttcgaattgtttcactttctaggtgcgtatttttgaataaatacataaaatctgggaccctctgcaagcgtaaaatgaaatgaataatacctatctcgtaaaggaggaaggaggaggaaacgagattaatcagatggaacaaaaatcaagaaaagaaagtcaagtggcctaacaatgtccggtacccagtaggagctcattaaatacaaatgaataccaatgacagtagtaacccaaagaaaagttattctgccactcggccatggacagaagtcctgcatcggacccttactacggggcttccttagaaatcactttctgtctatgaagcacagtgcactgtggtaggtggaataaacctggagggttgagactgaagagaagaggtgaagccatcctcttttctggcagcttgttctcggggaggtcttttcattcgtggaacttctgattgcttattggtaagatggaaatagccttatcaaccaatgtgcagttttgtggtaagactttgctaagttctaatttgtggatatttattttaaacctatcatgggtgttgtagtagtctaagagtctaaggaataataagaaaatagataagaaatagcctggtaaaaagaaagatgcaaggatttgatgaatgtttgactctaggacacatggggctgagtcaaaatgattgtgagagttcaagcatgggtgactggctggagcaagaaaccctgcactggagttgggggaagcagcaggttggtaggaggacacctagtgtgatcagatataaagaggtcaaattggaggagagagagggttacttgtgaagtgctggtgggaatatgggactgaaggtcactggagagactttggagtcacccttttagatgtaagacttgcagctgtggttatgagagggctctcaagggtgaggagtgggctgaggatgggactgtgaggaggggctcacacaggagcacttgggttttgcttatgtgtccttctaatgccatctctgtagaaaatgtgccctgtaaggtcagtttcctggaagctcttctgtgtgttgtcccttctccagcagtgggtcgattgtcagggagcccaggatggaagctaagtgcactggtcattggttgttctttcagtgcccttcagacagcccttgccctggtggtcttgtgccctccctgtctgtttggtgcctcttttataaattagtgatgacttcaggaaatggtcctggatttcaaatagctattcctggagacattctaattctgtggtttaaaccttaaaacaaacaaaccaaagtaattccctggatattggtggctactggtgtgaagagcatggtgcggcgcctgttacttggatgagctttgatcaaagaatggcatcaaatgataacagacattggaggtataagtgattacaaggagaatcatagatctaaataaaaatggaatggtggttaatactttaattgatcgagatgatacagcaatatttttattcatatatcagtacaatatttaacttttaaaggaagtgatattcatcttagcagaggtctcttagcaccatatttgcaacattggatgttatccattgagccttgttttggggaggaaaaaagacaccaactttcttgagtaaattgttctctgaaggtgttttacacaggaatacaaatttgcctgaactcaaaagggtcttgtttacagtactttaatcttgtttttcacttcataagccctctgtaaactgaaatacagagctacaggcaaacctcattttattgcacttagctttattgctctttgaagatactctgttttttttttttattcaaattacagatttgtggtaaccctgcctcaaacaagtctgttggtgccatgtttccaataacaggtgctcactttttgtctctgtgtcacattttagtcattatctcaatatttcagactttttcattactgttatatctgttatggtgacctgtggtcccagatctttgatgttactattgtcattgttttggggccccataaaccatgcccatataacgtggcaaaccttatcaataagttttgtgtgttccgattgctccatgaaaccagctgttccccctctctctccctcttctcgggcctccctattgcctgagacacacaatattgagattatgccagttaataaccctgcaatgcctctaaatgttcaaatgaaaggaagaatctcatgtctctcactttaaataaaattctagaaaggattaaacttggtgagaaaggcatgttgaaagccagaatacgctgaaggctagacctcttgcaccaaacagccaagttgtgaatgcaatgaaaagttcttgaaggaaattaaaagtgctacttcatagaacacatgaataataaggaaaacaccttatttctgatatagagaaagttttaatggtctggatagaagatcaaatcagccacaacgtttccttaagccgaagccagagcaaggctctaactctcttcaattctctgaaagctgagacaggtgagggagctgcagccaaaaagctggaagctagccgagggtggtttatgaggtttaagaaaagaagctatctccgtaacataaaagtactagacgaagcagcaagtgctgatgtagaagctgcagtgagttatccagaagatctagctgggataattgataaagctagctacactaaacaacacattttcactgtaaaccaaatagccatctattggaaaaagatgctgtctaggactttcttagctagagagtacgaggcatcgccttttcttaaagcttgaaaggacaagctgacccttggtaggagctaatgcagctagtgacactaaattgaagttagtgctcattttcccttctcaaaatcctacggcccttcagaattatccttaaatctactctgcctgtgctctaggaatggaactacaaaggctagataacagcacatctgctgacagcatgatttactgactattttaagcccactattaagacctactgcttagaggcaaaaaaaaaaaaaaaaaggatttctttgaaaatactactgctactcattgacaagacgcctggtcacccgggagctctgatggagatgtacaagaagactgatgtagttctaatgcccgccaacacaatatccattctgcaaaccatggatcgaggagtaattttgactttgagcttttttggaaggaatatattgtgtaaagctgtagtcactatagatagtgattcctctgatggatctgggcaaagtcagttgaaaaccttctggaaaggattcaccattctagatgccattaagaacatttatgatttgtgggaggaggaggtcaagatatcaacatgaacaggaatttggaagatgttaattccaaccttcatgagtggctgagtggtttgaaacttccagtagattaaataactgcagatgtggtggaaatagcaggcgaacgagaagtggagccttaagatgtgactgaattgctacagtgtcatgataaaactttaataaatgaggagttgcttcttatgggtgaataaagaaagcggtttcttgaaatgaagtctactgctgatgaaaatgctgtgaacctcattgagatgactacaaaggatttggaatatttcataaacttaataaagcagtggcaaggtttgagaggattgactttaactttgaaaaaaaaaagttttgtggtgggtaaaagatgatcaagcagcctcacaggctacagagaaatattttgtgaaaagaagagtccattgatgcagcaaacttcatttttgtcttattttcagaagttgccacagccaccgcaaccttctgcaaccaccaccctgatcagtcagcagccatcaacattgaggcaagtccttccatcagcaaaaagattaggacttgctgagtactcagatgatcattagcattttttagcaataaagtttgtttttaaaggaaagtatgtacactgttgtttttagacaaaataccgttgcacactgagaaactacagcgtaaacctaactcttataggcaccagaaaatccagaaatttgtatcacttgctctattgtgatatttgctttattgcagcattctggaattgaaccagcaatatatccaaggtatgtctgtctattgaattggctcaagctgttagcagagccttcatttttagtacttgagacagacagtggtcatggtgcaagggaaggtaaataagtttctcatgaatgctaatgaggattaatattaatctctgtcctgtctaatgttagataaatgcttccattttgtaatccccatacctcatatgctgtttcttatgcctgtgcctgacgctctatttgcaggtattctactggtctctgaatctaaaattacaaaaggaaagccttaaaaatcacacacactgaactcctgagattttctgatgtttttactcaccatcttgccacccaacagcattcacttgggagcttattagaattgcagaatcctcagccccaccctgacctactacattagaatctgcattttaccaagaggtccaagtggtttacattcacgtggaagtttgcaaagcactggtctacaacggtggtccatggagcaaagcttgagtagtaaagctgtagcacagtagttctcaaacttgattgctcattagaatcatacagggagctctgtaagcttctcatctccagccttcaccgtcagagattctatttgttagagtggcacctggacatggatagctttaaaagcttccccggtgattctgatgcgcagcctaggttctcaacaccttgctactcccaggtgtgggcctcagactaacagacatcacctggacctggttagaaatgtgtctctcagataccaccctggacctgctcgagcaaaatttgcattttaacacattcccaggtgatccatgatcacgttgaagtttgggaagcgtttactggaagctgcttttgagaggcgtttactgcaagttgcttagaggcagaatacaaagttgagccagtccccgttctcagggggatgtgggcctgttaaaggtaactccgcttttggaggggaggattctcctaacagaggtttgggaaagtgagtgctcctggctgtgaacctggaaatgatttcttctgttgtcttaggtgtggtggtgatagggagtccctccaaactatatcagcagggattgattgattttcctgcttaggaaacgtatggttggtggcgaagagtgtgggttcttaagtcggagtgctttggttcaaattttagtcaattctctgtctaagtcatttactggcacataatcagtaatcatttactggcacttaatgagtactcaataaatgttggctattatcagtaataacagtgcttgaaatgcttgaaatgtctttaaaacctcttcaaagtcacccagtatgaatggactgtggtaaaatcgaattgacttgagatgttgtttttctgtaataataattctaagagccttcaattccttgactctgaggaggtttaatgatagtttcttttattgtctttataattactctatttagaagccccacctcaacgcaaacaaggtgacattttcttgtcaagagtaatattataaagtctttagtatagagaaaataagatgtattgaatagttactattgcgaagcaatcctaaaatttcattattcgtagttggcattcacttagcaactatttgaggattcagcacgtagtattaatagtgttatacttcgctacaggcctgtctcttctgttaggccgtggtcttctcaagttctacgttttgggactcagagaacccctggcatagtggccagcacatactgggcactcagtttttgttgaatgaagaacttaatgagcagctgctctatagtagatactaaggtgtctcccaaacaggcagatcagataacttcagaaataactctagtgcagagcccagagagccaggcttcatggttctgagttgggggttacttgcatcgtgggatgtcacggaggtccttgtgggggtgctgcattttgaggtgggctgtgaaggctgagttggctatgtgtaaagggttgtgggtggcgtggagcagggtgacatgccagagagaaggagctgaactatggcagaaggagcagcagctgcttggatttggggacttgagagtgaagggaattgttaacctctttgccccctgttctgttaattgtccagactgaacaggtgttgctgcactcaaagaggttgtagtcattatgcagttggctttctaaagcttctgtaacatttgaggcataccaaaaagtgtagacaataataaacacctgtgatctcatcatcccacttaggaaataaaagtatttcagatgaattgcaaactcctctcctctttatgcccccagatctcattcctctctttccttccctacgtagtgaagtaaccatgagctgctgatgtttatcattcctttagagatgtgcatctgtaatcattagacagtgtttcacacacttttcagcttcatatacaagctatcttgtttccttttgtgaaactggccattgtgtctgagttctttcatacatgcaggttgcctttgcctggcagtggtggctgctttttgaggacatacctgtatttctagattgtccctttctgtctttacccttttttcctcagtatttgaaattcattcttattgactcagccctagtttgatcagtttaattgctgtatagtattcattatgtgaacatactataacctatttttttcatttttctatttatgggcattttgactgtcatattatgtcaaacagcatggcgatgtgcacagaaccttcatgtggctttttgggaacacatggaagaacttctctagtctgggtatatatttaggaataaaattactgcatggtaagtataatcattttctggtaaaccagaacattcttgaaagggcatattacatgttcttcgagtgtataatttttatccacttctgtttagaaagtaatttttagtcttttaaatctccaggtcctcataatccccgtatcccaacaaaaatagcaggatccccaggaaaagcatggaaaagaaactgaagtgaggctggtctcctatccctgttagggctgacacacactctggcatccattggttaggtctggcggccacggcttccagtggatctcaactcctgctgtccctggtttctcggatgcctctgtggcagttgttgcctgtgtctgacagctgtgtgtgttgcctggccacttacgtgtctgaagcaggctttggacaaccaacaggacaataaatattttcacatccacgagcagaaaaaacaaaactagaaatgaaaatagaaaatcacaaattacatgagattaagtgtgaatttaatagagctaaattgtgtataatattaatgacttaaatctattttgttgtctatttcagtcaagtgtgaatttaacagagctaaattgtgtataatattaatgacttaaatctattttgttgtctatttcagtcatttctttaggaccaggctgtgtgtgctgtaggaaattgcagtctataaaatagttgttcaaaaaactttagtgctattaaaccaaatcagtggcaaagttactttgttttgaacgatgctggacaaatgtctcctttcccttaaacggcaaccactccaaataagcttagacagttgccttttctgactgctgtcagcttgccatctggctcttaaagagttaaactagaggtttgtgaggtcatgagtgacttcattgggtctggacttttgaagcaggtctcttggagggaagctgtgttgagagaggaggctgggaagagggggacgtcctccttcaacttctttcaagttcgtatccctgagcccctgagggatccagtggcattctgggagaatgtcactgcggagtcagtgtgtagcagtttgtacttgcaacagaagcagctttagaagtacattaaaagagcccttgcggaagatgaaagtttgctgagcagatggaatgggagaatgctcttcaattcctgacaaaattatgggcagactgtttgctgacgaaggtaactggaaattggtgtattgtctttgtctggtcctaggcagtgctggattatgtataattgtaattgtagaaacttccttggatttgaaaatagattatttcaaatgaaaagcattgtaaggagatcctaggaaagacttaggaaaatgatcatatgttaatttctaaataaggatgacaaatgaagagtatatttattacagggtctacaatgtttgggcaaaatgagatttttccctagtggagttgtgctgctctttgaggcgcttagacatagcttggtgttcctagactgcatgtgaactccagctaccctttgtgaaacttcatccaggctgtggaaggtcactaatttgagcttagtcatgtagtggggtccgtaatgactactgcacaaggctatcattcttattttggtatatcactgctctgaagggaaagttggctgtgctgttagtatggaaaggtgattcaccttagaattcaacgttttactgaaacttcaaagattaaccagttatctaatgaaaagggcatagggagttttttttttccccctggagctgagggaatttcagcctcacggtttctttctgggaaagtttctgttgtgatgttcaacaggcaggggataagtgaggtcaacgatgctaaagaaggggaattgagcctagtccgttgatattatgtccattttcaagatgcctgggattgaagaataattcctgaccatccagaacccagcaagaactccagggcttgatcttccagggtagtcaatgattataacaggtgtatttgtgggtatgcattggtaacattggcattgcttgccttgactatggattgtaagttcctatttccagtatttttataatgccatttgtctggctagcccatcagtataacaattttgcctcttctgtttggacattttgtttcataactttaataagaaatgacaaagagaatatttgagggaaaaaggccatgaaatatattttatgagagacataagcagagtggctctgagtctgacttaggagtcataggcccataggcttcagttttactccttacagtttggtctctagcaagttacttaaccacttctgaagctcagcttcttcgtgtatgaaataggaatgataatagtatctaacatgaggggtggtggctgtgaggattaactagtgtgtagtgcatgggaagcaattaccatagttccttctgctctaaaagagctcagtaaacattaatgatcattggctattatgacgtttaaattgtgcttccttatgtgaggcacgtgaggacttcgatgttagagcatgatggtgatgaatttgaagttgtgggcaagctcacactgtaaacacatcagggcttccttgtggccaggttccagggtagcacctctgttctcgtctcagtcagttgggcatctctcaaatgcagccttcagtggcaacgggggctgggagaggaaaatgggtagattaccgcaggtccatcagcactttgtgaaaacatctgtgtgctcatgtagtgtggagggcatgtcagtttcataaatatggggagcagcattgtgtacacatgtaccccataggcagcatgtgacccactcaagaaaggactgtcagaaactggccattgtgtctgggttctttcataggtgcaggttgcctttgcccagcagtggtggcagcttttttaggacttgtctgtattcctagattgtccctttctgtctttacactcgaggagttggtagctgtgcagctgtgtgaaagctgcttagcttctctgagtgcctggtctgagtttcctggtctatcacttgtagataatatttttattccatggttattgagattaaatgagataaagtatgtgaaaatgcctaaaagaattaagtactaaagacttttttttttcctgcctcaaaaatggctcaatttcttctgttaacagtcaagggaaatttttgtaaaatttgtaaataagaatcttgttatactttataaaggtcttacatttaattcagtgtttctaaagctcttgtttaaaactgttgtgtgattagtttacgtcacctgatgtcagtttctttttgccttcaccactttccagtgtagactgtcatccttatgggttttagattgaattttgatctagttttcaaagatattatgaaaggaatacaatgccaacggtaaaagttccattggtcccactctccagaaggaatctccactgtcagtttctagtctatcctcacaaggcagaatctgtgtagctctttgggagctgatttgaaactgccttgttgttgcagaagtacagatgtggtagggaaagttctgtcgggcttgccagctccctgtgcagctcggtccctccctgcaattccgtggcacagtgtctggaatgtctggagctcccttgatgggaaccgcctgcacagctgggttgtgtcaccaagagccgaatgtgcttgacaggtctagctccagccatgctgctgtgggacatgtgattaacccagagttcctgtaggagagcgaagagcttgcctcgtagcagagggctggtctgaatccactctggaatcctgtcctgaagtcctgaggagacagagcctgctttgggttccagctgggattttagtcattgtttagctggccggaggctgtggttcagttggccctttggtctattgttatatttggctttttgtcatgaatatctttgggtggaggtagagtagaaggtgctgaatatggagttggaagatgtaggctcaacttccggccttgttgtttaccagctatgactttgggtaagacttccttggtcctcagtttctttacttgcaagatgggactattgtgaggatgaaacaaaataactatgggaaagtgctagatggactgcagagtgctctgtggattttttggtttgtttatcttattggatgttcaaaggacagtggcttattcctcttacctgttgagatagactgaactgttgatgcttcgcaggccaaggaacagttgtagctgtctggtgttctggtgtccttgcactttgtctcgcttttgtggagatcttttgtcccctctgttcttgaatgctcctggtatgcataagaacctgtattcagaagggagggggggcaatagagtttctgtgcccagcatgttcttaaggaagccactcccttttgttgattcagctggtcctttattgaggccctgctttttagcaggggaacctctgttggtccaactctgctattgatggtgagacttgggaagagtcgcgtcctctcatgacccctcagtttgcccatctgcagagggggttgagctacaagacctttttgtgcatggggaggagagatagtgactatctttccttttctacttctcctttaccttgctgtattcaccgtcttactgggcaatttttgcctccttttaaataacttacgacaattgtcttagaaaacataggacaagtgagtaatgaggctgaacttctagctgagatgccatgttgacttctgagaactaaatgaatgaaaatctcttaagggtgacagggtgttaaggatgagtatcaaattgtcttgcctataatctgctgatcttgacatcgctttgttttgtaatcatccacagctgatcatctttgatcagggcttctgggtctcagatccattgttataggagctgtgagtacctgaaaggagccagggagaaaggatgtcatgacagctggtggctgaaatagagatgccaccatgagaagacatggagaatgaatatctttcagcgtgaggcaacaatccctttgggacaggggaggggcctttgccaggctatgtgggagatgtttgcattgctgtggttctggttttcaatgcttttcatccatcctggttttctcaagctctttattatctgtatgttgttgaacagagaagtacatctatcctgtgtggacattttagtctagctttcccatggcaagactgaattcctagatgacagtaataggataacatttgtatttcttcagtattttgctgctgaaaagataaacaagaagagttaaatctgtctctgcagctgattaaccagaaggctcattaatagctctagtggtgggaaacagtcactggctgctagaacttgtgcatctagcaagtcccttggggaactcatcgattggaccaagggttggagacccatggaagatgtgcttctggttgaaacagtttaccttagatataaggagaaaagtttaccttagacatgagggaagtcatagtttcaaaagacaaggtcagtcagtaagaggaaagaatccacctcagagattcattgcagaaggtcacttccaatagatggcatggctgatagtagatttgtaattactgtagcgcctccgaatgatatctggcctcatgggagcatgtagcctatgaatgctgttgccatagttgtgagtaggaggataatgccgatatttcaggtttctagaaatgtaaatgatacctagtatagacctcggccaacatgtaagaagaggcagatgaaaaatattgaagtgctgttagcataaaaatagcggaccattcagccgtagtttacatctcggctgatatgagcgactgaagagaaggcagttgaggtgtctgatgcatagtgcatggccaaaaatagtactgtaataatctagagggttagacaggcaccaagaagtgagccgaagtttcatcatatagaaatgatagatggtgtgggaagatcaatgaatgagtaattgtctgtgattggaattctctgttttagaccctttcatttgcaatgtaagtggaaattctgttgatttaggacttggcactttttactaaatccctttaccttgcataagttttctaacaagtagatgaatacctatttagttgccaggtgtataaatgctgcttcgggactggaggcagcgatatggccaacaggtgtagaagataaacctaagggtgatctaaggtgattttggccttggattttctgacatcttgacctttggaagcaaatctgtctcatcttgcattacagctttgaattcatcattgattgactttgtggaaattgcatagctgagcatttcttaaaagcttaaacatgagggaaccaagaagtatccgcttgaaatgtagccaaagaatggcagttgccacatttttgtatgacaataaacaacctagaccataatccccaccgtctctgcattccgccccaacctagggtgagtttactggtcattctgggactcctctgtgagcaacaagccagtgttttgatagtaatttctttctttaaaggagaaaaacatttttagtaacaacaaaaataggcacccaccactacacatacatacaagaatatttctagaagcacccctacatgagagagaacatacagcacttagatttgagccgcagtcttattaagcgtttaaaacttaatcaccactgctacaagctgcttctcagttgcatgcctggcttggctgcctctccatgggaggtggccatttcctgagtcagcagtatctcttcctgtggcacccagttcttcttgggaggtctcagggccatgcaaccaggggaccagctctggcaagaggctaagagatccatctgcagatgctaggttgcaggccaagggtggggttgccctacgcagtatgtattcagtatcaaaatccatgttttgttggctggggtagaagtcatatttatgttgtgttgcgttcagttttaggaaaacacatctgaagactgtctgatgtaactgtacaccaacatggttaaacagtgaatgccttcttttagagaaagttacttcactgtaaaggaagtaacaggatttagggatttttttttttaactctcgaaagcttgtgtatcttgtgatcagtagctagcctttttgtgttctgatgctgttcttttcacctgctttcttgatgacacgtgttccttcccctcttttctttctcttccctgcctttgcagtctgctttatcttcaacattctttgagttgtcatgggtctttttcttccctgaatatttaaccaggctcatgtctccccgattgtttctgcagcccacatcctatcttgctgattctcactagccattcatggaggaggactttaagttgttatgctgctatggccattgcacatccaaggccagcgtgactctgatcccagggtagccttgtgtttgcgggtgccacagagggtcaccagaaaagcattgtgctgggagtcaggagactttggctctggccccagctctgtttatatctaagttcttcatctctctctgaagctttcttttacttatctgaaaaattagatttggttaaataattcacatggtgtattccacctctgaaaactcattacttgacggtacgaaatcatactaattctggctccttagattagttatttgtgaccagttaggatcgtttattcaaaacaaattgaaaacaacgaggatactgggattggagcaggtagaatataccaaaaaagtagcaacagtgtgcatagcttgcccagtgattaaggcagagcaaggggagggagggagagagtgcttttggctggtttgcagtcttcctgggctgcctacacagcttgacgttttgcattgttctttcatggaagtaacatccactggttatcttcactctgagttgactgatgggagatatttactttgaaaccccaattgcaccttttccaggaagggaagcaccaggacagtaggagatcatactgcagtctcttttccttggctcaagtgactggttgatggtgcctcttctccatcccttttcagaggggcctggtttctcgcatgaaagcagaagtgtgcgcctcagcagcggaagtgaaaccagcatgtaagaggtgaaaggcagtgtcgaggccaaatcgggaatttcttgactcttgcttatccaggacatgggtattgtaggcacaaattgaggcgaatttttctccctttagagttaagggagcatgggattggcagggtggggcctggggttttcctggtacttcacatgagctctgtctttggctgtgtcacctacccgtttctgagctgacctcatctttaaaatgaggttgttgggccaagccaaacaatttagggttttttccagcaccaacctgccataatctgtaatttccctcttcatgagcaagacccctagagagatgtggcaagtgagggcaaagggagttgagaccagtcggttttgccggcgcctcccgtgcatcctgcaacttctatccaggcagaggccgtcttttaatttctgcacagcactaagtccaggttaccacaagatgtttgaaagttgattgttacttttggtcagtgtactgatttgttggcatttgttgatcatttgtcagcagtccgtgaccctctctgccaggaatacaacctcccagagacattcatggcttcctggtgtgagtttccccaggagtagcagtagaaccttcgaacccctgtaccttcacaaggaacatgtttccctgcagggcgtggtagaaactgttctatcgttagtttccgccccctacgtttctgttcatctgatttttcttcaaaagcctcaaggacattcgtagccccacagcctctgttaaatgttggcattcaggttgaagggcctacttgtgcccttgagccttggagtgaggtttagcagggaatatcactgtttctctagagaaatatttacctttgccttcttggtaatgatatcacaatcaaaacatttgtattgctactgatacggtcaaacacatgcgttaaatggcttattaagaatgttttttgatcatgagggaatctgcaaatctttcttctatctctctttcttttgcttccacagggtaactttatagtcaaattgataagcatttaatatacatcccatctctacaaagaataccagtctagtcactcccagagagtggaatgctttcgctaggctcataccattgatttaggcgaacagtattgagtggagattattacaaatgcatttaattattcatgctattggtcaagaaatataaaggatttcatttagatgtgtttattttcttccaaacagtaacttcagtattctttcccataaaatcctgagactaagtgaccagtttgagttcccttcttccgccatttattttaattttttttgtagaggtggggtcttgctatgttgttctggctggtctccaacgaccggcctcaaatgatcctcctgctttgccctctcaaagtgttgggattacaggtgcgagccaccacacccaccctcttctgctatttctaattgatgctgcagtaggcctgtgaaactcctgctgtcagcagcagggagggagaagagggagtgaaagaggtccagcggccctcatgggtgtggctgacactgcccacagtgttggtgggggccgccccagagcactctcagtgtggacgcacctgtcttccgaatgccgtgctatgcacctggaagtgacgagtgaaggactgatgagggagttgccaccctgcttatgtcagtaagtctgagaatgcagacaggaccatgtgagtgggacagtgcagccgccaaaggcctaggggaccccatccactccaggagacgcagggtttcttcagctcactactgagatgacagccgttcctctcgccatcctcttcaaagtcatatctatgatcaataccctttaactcataaattacctataatttatgctgccagcttcttggagtaacagaatctcaaatcagaatggtagtaatgaaatattctttttactttcaaagcaatattctaatagacaagataccatatttttacctcatgtttttcctttagaatatacttatcctcaagttaaaattttatcccctttacataacaagattttagaaaatctaggccagtttgaactcccatgacgtgctttgagccatccatggctgtacattcccagattttagtgcaaagcctttcccaccaatttggaatgaactgatcattgtaaccagctttgtatgaaacacttgtttcggatcccagcgctgtagtgatgtcattttctttatacccaaagtaaatgctatgcagagtagcttattctggaatttggctgtacgattcttctcttggttaaaatcttccatagcagaggagccctgctaagtgaacagtctctcttacacattggtttttgtgcttctaactaacttttctaataatcttatttttccctgagaaagcaatccatcctatttaatgtggagtaggggttgtggttggaaatgaaaacaaatccagtatgttctagtctgatttttttttcttttttagcatcagtgtgttttcagtagaagtgattcaatcttaatgtggtttgggctcaagggtagagaacaataagagctataaatatagtagacaagagggggatcatgtttagtcaagataaagtctactttaagttgtttccatgtaagaccttgaactaaaaagaggaaaggtgttagatctcctaggactcattattagagttttaaagtttctgatggaaggtataagtgtctatcttaaattatttatatattaatgaaatacaacagggaaaagatcaatttgtaaaaaatttcaccatctttagaattctcaggggacccaagggagaaggggaactttattttctttctttccatggtaccttcgtatttgaagactaattatcagaactcttggagtttttaatcctggggagatacagctcttagataattataggtaatttatgagttaaagggtattgatgggagtcttcccataattatgttaaaatttggaaccccatagagccagctgctggacatctgtcttgtgggaccagaactcaaaacccaatggacagaaccttgtgtagggttaaccttgtttttttaaatcaggatatttgtcttcatagcccagcttgcccatttcctgacagtattgccttgggtaaaaaaaaaaaaaaaaaaatagtctatcttataaagtggttatagaagacctacttcctggagatattgtcaggatcaattgagataatgcttgtgaagtgcttgacatggtacctggaaccagtaagtgcacaataaatattgtcaactgtcattcatcaccatcaccaccatcatcagtactggaatatacctctattttaccatgcttttgatattagttcccttaatcacaaagcccagattagcaacaaataacagtatggcacactcattacttctctacttctctattctttgtaccgtttttgatgcccttgggtcaggggtgttaggtgaggactgaaattgtatctcaaagctgttattagaagaggagaacgcattataaacccagaatacagagtgctctgaagtatctttccatggaggaggggttttcctaatacctcttatattacttcgttatatgaagggaaagggaagaaaatggagaaattaaaatattctttgaattttgctcagatgtttaggtatggtgattctaattcctcatgctgcaacttgtctacctagagcaataactctttttttttttttttgagacggagtctcgtgcgatctcggctcactgcaagctccgcctcccgggttcacgccattctcctgcctcagcctcccgaatagctgggactacaggcgcctgccaccgcacctggctaatttttttgtatttttagtagagatggggtttcaccgtggtagccaggatggtctcgatcgcctgacctcgtgatccgcccgtctcggcctcccaaagagagcaataactcttgctactgggttcctctaatactactgatggttttatgtttttattaacagctatagcaaaggcagcctttttgagtggcatattgactgtggaaaaaataacatggaaaatgaatttatctttataaaagaatgatatgaaaatgtatgggtttttgctcaaggaaagtccatgcctggttccatgtgttctggcaagagggaacttctgaggaaggcttcttctgtaccttaacattgcatgaggcttcatttaatcagtgcattcatccctgatagatgtttgtctaaaacctttgctgaagagctcttcttcactgaatattaatagtctgtatactagtaaagccatacaatttttttttttttagacggagtctcgctttgtcgcccaggctggagtgcggtggcgctatctcggctcactgcaaactccgcatcccgggttcacgccattctcctgcctcagcctcccgagtagctgggactacaggtgcctcccaccacgcccggctaattttttgtatttttagtagacacggggtttcaccgtgttagccaggatggtctcgatctcctgaccttgtgatccgcccgcctcggactccccgagtgctgggattacaggcgtgagccaccgcgcccggccaaagccatacaattttgtgagagctatttatcttaaattatccagattgctctcaaagagaaccaaaattgtttttcccatgtaaatcccttatgagagcatttttatgtcctacttctaagtagtctctacagcgcaaaagggttataaaatgccatgtagactttggaactgtgcagtcttcagctgccttgggtttatgggaattcacatagtgatgtcgcatagagtagctgtggctttggtctaagctgctctggctgtgggccaaatgctagttggtgtaatcctctgtcagcagatgccaggctcattatggacccagcagtaggtactttttgcttcttggtattccaagactttggaaatcctggttaacatgggaagatggtgaggtcttactgggtttttggccttggaaacagcagaggagagccatccactgcctttctgctcctgtgacacgtgggcagggtttctggcagctcttccttccctacctctccactggtctgaagtattgtttagaaatagagtaggttttatatcaaaagtctagttttttttaaagtctttaatgaagggattagggtctctttactagctaatgtgtttagattcattttgtcatcctcatgtgtttagggcttctcccccaggtggaatggtgtagaagaatctttctatgcctgtctttcagagacttcctgaagatggttcattcatgttagcgccagatggaggtctcttgaaaactcaaagaattttggctatcttcattatacttgagtcgcctaggcatgactggttgatactagctgggcacagaccagagaagcccacacattcaccagtgtcctgcctcttacccacttcaaacaatgcctgctcttccacatgagacctagagagccccgtctgctctctccatgctagtgagtgtttaaattcagtgtgtgtgtgtgtgtgtgtgtgtgtgtgtgtttaaatagcagacactcttaaaaataaagatttactaagaactttaagttttatcagctgtttgaaagtagagctgctttgttgagagcctgaatgggagctgctgagctccactctctgggcctccccagcactcccaaggtgctgtgttttagtgggctgccctcgctgagaatacacaacagactttttttccacgcagtgcctgagcatgcatgaatattggcatacacactagccagccataacaaacacagcagtctgctaagccatccaattagtgtggttactacctagctgccttaggcctgagttgtcaatgctggcagcaggcttagtaggtggtttgggttgtaaacttgatttttacccaactgaaatcatgggactttcttctgctttctatcctctacttaggttcttgttttagtacttttaaaatagagcatgatattctaataaccttaccaagtgtagtagactgtagtagaattttagaggggcaaggtgcattcatctatctcgagacacacacacacccagatgaatgtactgatctcgaggaagtaagacaacttgcccaatgtcacaccgttaatagtgaaattggaactagaattccctttatatattctgtattccagaatattatcatcatgtgcctctccaatctgactgctgtctgtgaatctgctgtcccacactggcctgacagacctctcccagagaggcaggataagctgtagttcagggtgtggtctctaaagtcagactgcctggatacacattccagctctgccactggcctgccgtgttatgggaaacctagcacctgtgctttgttttcctcatctgccaggtggacatactaataatacctacttcgcaggattgttgtgaagattaaatgtgttaatgcctgtaaacgtcttagaccaacctggaatatcggaagtgcttagtacacactaactatcgtttttgtctgaatgctttgaatgacagtggggacaaatgaaagctcatgatagatcccactgaaatgtttttctcagcttgagtagaccaactagggttcatttaaggacagcagaatgtctgtaccaaccctaccaacccccttcaggtcatctttgggaggccaacatgttcatcacaagtgtttgagacattttggtttaatgcaccccacacaacttccccacctattactcagagtgattgagggtttgaggcttagctgctgagaatgatgtgggggggacatttgcaggtgggtggtagttctcattaaactcttctggctttattcacttggcattcacattcctttgatttactgtggagtgattttgctcaagacctagagaacaacaggatcagcattaggattcttaaaggtccatggaatgactactttctactaagcacaagccagtattttgttcctccatgtaataatgtaagttattatgtagaattcaacagtttgtgggaggggagaagtttttatggaagggtggcactgtctgtctctgtgaatgatgtgggtgagataaccacaaagtattgctaagtaactaccacatttgtcagtccactgccatcgactgtgtgggaggcagggaagacacagtgtggagctaatttgtgtcatccctgtgtcatgggagagttatagccaagcccaagtgttgctttgcgtgatgagtaagatacttggaggagaactctgatcttacttgagttccacgtggagttgacttacagtggtgatgctggtggtgagtggtgtgttctataactactggagctgcaaaaccttctgaggaaacgtgtttttctctgggtgagtaaacctggttcctgcttacatttgcagaagtgtttctccttaaagtaggccgcctctgtgactgcccggaaccatcattccccttggctttgctgcagcaaacagactccacctttaaagagctgaggagttgtgggaggaaaagcaaatgggaggtgttctcatgtcgcaagagatgccagggaaattcacctttggacaatagatcttttacaaggcaaacttggccccactgtttttggtgtttatcctgtttcatgcttaagaaaatattttcctataaaaacatagaaacattcagctgagtttgtgtctaaaagttcgatggagaaaatttggacttgaaatgtctcttctgtccatgctctgtattggtaatgccagaaactgatgaactcaccacatttacacttgtaaatggtatgtctgtgctcaagttaggatcctgggaagcaattgcggctcttctgggtaagatgagctgcaagcagcctggctgtttgggagagagctcagtgcaggaagtagtgttggagctttagttccctttttaaaggcctctcccttctgcttgttttaaagttggttttgagttgtctgtcatcccatttgtatgataagccttttcctcaggcttttcatctataggatattcagagaccaattaagatgattgagaaacaaataagacctagtggcaaaaccttttgaaatgcagtttactagcttgtgagccactgaagtcttacttttttcttgaacattattattattattattattattattattattattattattattatttgagacggagtctcgctctgtcacccaggctggagtgcagtggcgctgtcgcggctcactgcaagctctgcctcccgggttcacgccattctcctgcctcagcctcccgaagtagctgggactacaggtgcccgccaccacgcccggctaattttttgtatttttagtagagatggggtttcaccatgtgaaccaggatggtcttgagctcctgacctcatgatccgcccgcctcggcctcccaaagtgctgggattacaggcatgagccaccacgctcagccggaacattatttttaaaaacagaactttggtttgcacatactcagttgccccaacttcatttatttatttttaaagaggacaggatacatttactgaataatatttacatttatgaagcgcagaaatgcttttgtaaagcagaagacacaaaggagggtcagacgatttcctttcatggaaacccgttttgttcactttccaagcatggtgaggcattgctgacctttaggtaatttttcgtacttaatgtttcttgatcacataaagccatcgctctacatgaaatcagaactgaagcgctactgtcattggcagaatattgttttagaaattaaaagtcccactcagggttgtaaggtgaatacagtatgagctgtgtcagatggcattatatgatttcacaaattattaatgagttaagccatatgattcatttgatcaatgagataacttaaaacctttcataattatgttctttagtagagaaattagggagctgtgtctgtacacgacaggtatttacaacagtcctctatcatttcatcccagagtgactctccccttacctactagccatctgcctgatagacaactggcatcttcaagatcaaacaaatcatgggtctgattgagattagtgaacagccatccttgttcttaattcaagtggagaattacttgaacatctcagagatgactagtgcttttatttttttaaatatgtttaaattttaattaaatatatagggacggggtcttgtcatcttgcccaggctggtttggaactcctgggctcaagtgattctcctgtttcagcctcccaaagtgctgagattacagacggagccaccatgcctggcctagagtacttttagagtttagtctcatttcagttactatctacatttatcatcttttgccagtgagtattaaaacatcaagaactaaatggtttgacctaaaacctccacttaatcccagttacctatgaggaatacactattagaacagagagcagaagcatgattagtttcttttagagccccctctgatttttattgaacttgctcctactcctcttgagcttggcgtatgcataggaatgtttattttacctgttttaagtgacgtttacttggaagcatttgagtagtttataaatacatggtgtcatagtattggcttgtgtcaggaagacttgcttaccacaaagcagtgaagtctcagtggagagctggcccctggtctacagagtgacccagagctgggtcatggctggttcaagagcgtctcacattcgctgtctatcttatactgtctggatcttgagtttttgcatgtgataagccatccactttttgggaatatatatgctgtctctgtcactgctatctgggattcagtttctagtttctgaccatagctcctcactcctaccttgtaggctcctagctcagtccctttctctccttctggatatttagttaaaagccttgccatcagatcaaaccggaaacaaaacttgatttgagcaaggtctgcatgtgtattaaaaaaaaaaaaaaacacgtaagaaacttgaattttttttagaagcaaagtacagtcagccctggtatctgtgagttccacatcgcattaaaccaactgtggatcaaaaatattgggcgggtcaggggaggatggttacctctgtcctaaacatgcacagacctttttttttcttgtcattatttcctaaacaaggcagaaaaacaattattgtcatagcatttgcattgtattcagtattatcagtaatctagagatgatttaaagtgtaccagacggtgtgtgtaggctatatgcaaatactacaccattttatataaaggtctggagcgtccataaattgtggtatccagaaaggaccctggaactaatccctcatggatatggcgggacaaatgtatatattcactgaaaacaacttgaaaagcacaaagaagcaaataaatctattagtccactattaaaaaattagtattgttaccattttagtattaatatatgcatttccaacctctgtgtgtttgtgtttgagtttgcatgtgcacagataaataaaatccacataagttaatgtccttttggtattctatggtgtaaaggtaatctgatttatttaaaataactgattccgaaagtatgttgcaggaaccattgatgatatttgagataactgtagggaacacctgagcatgtttgctttttaataattatatttttattttatgtgtatttgaaattctaactgctgcatcaaacgtgagttcagggttacggttactttgaaagcccattaaatgcgggagtctccagcacctttttggcatctcactcaggtgatttcgctaggtctccagtattcagcatgtcagcaatttggtcagctctaccttcaaaatacattcatatctcaactgtgttaccactctgaatgctactctcattcaagtgatccaggtgagcacggtttattcccatatctttgcaactaacaccctgctttagtcttttctcaatttgttgacttatctcagagtcaaagccagagcctttaccatgacctccaagtccctacacgatccgcccccccatctacaccgcatacaccgctctgtggcctcatctcctcccactcttgttgctcactctgcttcagttgcattggcctctttggccatttctgagcacgccgggcatgcttccacctcggggcctttgcctttgcttttctttctccttgaagtgttcatccccagagccctgctctcccacttcacatttttaatgattctcttctgttgggcacttacctgcctgccttttctaaaattataactcttttcctctcacggtttcatattctccttgcctgcttccccacggccccttggctgtattaccaacgtactacgtattttacttatcacttctctgtcctctaaaatgtaagttccacgagggcagggatttttgtcttgttttggtcactcctgaatctagaaaagttcctggaatgtagtatgtagtaggcactcaataaatactagttggaagactaagttaaataaaaatcatgacctgacttaataatagtaaatcaatacatgaggtataaggatctgtaaaagtcaaaaaggtgatgagtaatgcgtgaaaaacagtgatatgttgtaaatttgtttcttttgtggtcttattataattatcactgcagtaaatacccttaagtaatttttgggtatgtttatgattcttttcttaaaataaatgcttagacatataattgctggttcttaggatatgcatattttaagagttgttagacctagtccaatatatatcagattgtacttctgcctttaatgtatgagtgcctgtatttcttcgcatacttgactgtcctttgtctaagtgcttttttatcttaaccaatttaatggctgaaaaagctatctgaataccttaatttgtatgtctttgacatggatgagctttatttccacatgtctaattcttatctgcttaccctttttttacgaattgcttgctcacatctgttttggtctagactctggttgcagtggactgtaaacctacttgaattaattgtattggatggatgtcacaggcgttgggtttatatccaagaacaggatgcaaggaacagtgagacctcccagacacaagaactgaagggtctgcttctctctgccatctctactctccctttttttcatggcgtctttgttcctctatataactcttcattctacctggctttggtgtgccatgccacttagttcagcccctactttatgtgacctttcagttcacgtacccagtcatagtttaagtgcatgggtatccgcggcccagatttctagggtgagcagtctgttggatcagttttatcagctggtcactcctgttccagtcagctgaggtcagcatagagagctgaggctcttggggcctgttgccaggggctgtggatgaattgacttctctagccctgacacaaggatgcagtgattagaatgctcagtacaatgtattttgccgattttttgatttgttgtattaatctttctcttatgggtacccaaaagccctttccatttgaaggatagtattgccttttgtataatgggtgtttttctatccatttatcattttaattttgcttagtggtgttgccatgtaatcaaggctcaattaaatcatgatttctgctagtttctaggttagaaataccttctttatgaggaaattatacattcaaatatattttcttcaagttctctacattcttatctttcatgtgctctttgaattggattacattttagagggattagtgagagaaacatctttacaatgtttattgcaggagcatagtgtttatttaactgtaattcacttctctcagcaaaattttgtactttccttattttagttttcttaagtttattcctagctacttcataaattttattcttggtagaatttttttcagttatgttttctaactggtccctcatgatttattaaagctattgtttttatatttttgtaactgactatcttactagttgtaattttttgcttaatatttttgggctttacatgtcaacagttatatgcaagtaattattttatttctacctttttctattttttctttcatttctttttctcaatttattgtgctagatcttttaaaatgaggataataattgtaatggcaggtagcacatgtcttacactgttgtattttttagtgataattattctgactagataactaaatgctgtctagataactggaatgctctggtaacttacacagcaaatacaggaatgaaactagtggaaaactcattttaaccccaaagattttctccactggcttgtcttggagccttaaaatttcactcatttatcagtctttctggtcaaagcactgcctccacaaagttcctgttaaaatgtattatacctgctaagatggcatgtcacatatttagttatctgattattttctaataaatggtactggcctattgggaaagtgcaagatggacctcaagcaaagggaaaagtgttttgatggtgctgtcagtgtgagccttcataatgaagcagctgctcacctccaccttcatcttctgcctgctctgtgttcttcacactgtctcacctccgtcccacaagcttcaacctgagtgaatgtcccttgctttttaaaatatgtcttgttatcttgcctggggctttcctgctcctggtcctcagtgtcagtttcgctgtcactttctccaggaaggctgatgtccttagactaggctatgtgttctattgcattgctcctttaaagtaacattttaaatctttaaaaataacattcatctttaacatagttgctttttaaaaatcatctctcatggctgctcaattataacctcaaactgccatgccagagagcatatctgccttgtttactgatatggtttggctgtgtccccacccaaatctcatctttaattgtagttcccataatccccgtgtgtcatgggaggcacctggtgggaggtaattgaatcatgggagctatgctgttctagtgataatgaataggtctcaccaggtctgatggttttataaagggcagttcccctgcacctgctcttttgcctgccaccatgtaagacatgcctttgctcctcctctgccttccaccatgacgatgaggcctctccagccatgtggaagtgtgagcccactaaacggctttcctttataaattgcccagtcttgggtgtgtctttattagcgctgtgagaatggactaatatgttgaccattatgtctgacacacaatagtcactcagtgtttcctaagttaacagttaaaagggggttggaggataatgcttgacatgttattggtgaacttgagcaaccacagtgagctgtactggttggcagaagtagcggcgtagggaaattggagttgaaaggagtgtggccaataagcctgtgcccaaaacgtttgagttttatcctgatgtgaatctatgcagaactgaagggaaagcctgccttctgtttactggagttgtgcacagttttgaggaatttgaaaaaaaaaagcagttttatacatagatgacctctgtgcatccttggacgtgaagcaagatataaccctatactttatacttttatcctttaatttccttactctttagggttgcagtgatacatccactgggcttttacagcatctaaaatggcaggctggctcataaagtatgagaactccacctataataaagaccatatttcaagagctagagtgaaaaaggcagttggaggaaaacacaggaatgtacataaaagtatttggtgctgttttgttggcaacagaaaggaaggtttttgcttttgtgagcctggatggttccagtttatgaaaatgttttcagaagttaatacaaagacattgtttcaacttttctcaagttatagtaaacttacctttcttcccatactttttctattttttttttgttatatttattctgttactataaattacacactgaactcagaactgaatatgaatagcaagaccaaatccttttttggctattttctatagcttatttatttgcaacatgtcttcatgagggaacctgtttgatgtcgtgtttgtttgtttattttatttcatttgtttattttttgagatggagtctcactttgttgcccaggctggagtgcaatggtgccatctcagcttactgcaacttccgcctcccaagttcaagcaattctccttcctcagcctcctgactagctgggactataggcgcccgccaccactcctggctaatttttgtatttttagtagagactgggtttcaccatgttggccaggctgctctcaaactccggacctcgggtgatctgcctgcctcggcctcccaaagtgctgggattacaggcatgagccacggcatctggcctgatgtcatgttgaactgagggttgaccttggagaactggaactaaaaatacggtgatcaaactgattttatgtgaaattactatatgactaataaaattaagcaagttgagactgctaatcctggtacattgagttaggtggtactatacttaagttcagagccattctagagctgcagaagggtgtgtatttaatactttcactttacagatgaggaagctgagatgttaagtgacttgattgaggtcatgcaggcgtttagcttcagaaccagattaatagtagctgccctattttatgcacttaggtgcactcctaccccattttatagatgggcaaactgaggcacagaagcaaacgtcagagtcaggatttgaaccaaggtggtcggtgtcacaagtccttgcttttaacctctaagttgttttgcctctgcctcgctttctggataggcagtccattattctctgcccttaacaatgttgcctcctagaatgaatggtttcagggaagctccttccccagtaaatggctcttgtaggtattttccatagctgaaaatggtattggcctttccccaagatgctctgttctcatagatggtttaggttgaaagaatccagtctgtgattagagaaccctgaaacgggaagcagatacttccatgtctacactgcagtgggagcagtgcagccaaaggacagctacgccttccgaaggggtggagttcgggttatgctgcagtctttttatctcctttcgcgaccatgttgttctttaggtaactcattttttaaaaaagtttgcccaaaagccaacaaatgaaagtgattgattggataaccaaagtgtactttgatacctgatatctgctcctctgctttgaatgacagaagataatttctgttgttcttttaaacaagttgcattgtgcctgtgttctgtgtcctcctgggaaatgactaaaagagatgcccagaagttttggtgtataaaacttgttgtaaggcaagagtcacccacaatgagtctggtttaggtgtggtctattggagtttaattgggaacaccaaatataacttgagcacatttcagcaacagcacttgtaggacctaaaggctttaatatagcaaggtccttggagcttgaggactcagtgggatctggagcctatttcattcagtagaaaattactggctgggtgcggtggctcacacctgtaatcccagcactttgggagaccaaggtgggtggatcacttgaggacagtagttcaagaccagcctgaccaacatggtaaaaccttgtaggagttgtggcacgtgcctgtagtcccagctactcgggaggctgacacaggagaattgcttgaacccaggaagcagaggttacagtgagctgagattgtaccgctgcgctccaggctcgctgacaaagcactccatctcaaaaaaataaaataaaataaaataaagttattaagatttggtatcttcagagctttttggggaagaaggtatggttgtgattattattttttatttttatttattattttttactatcaggccctgtgaaacggttgtcttttaaaaatgtctttttacaaaattgtagtaaaaattctctcaaacggtagagtatcctttaattcatctcatgtattttatttcaagacagttaaagaagtgccctattagaggcttaacaacagtgctacgagattgtgaagtcatgtcagtcgagggtttccgcaggcttcatagagacatctgatttgagccttgcaggaggagtagatgtgtgtgctagaagggagaggacacctgaagcttaggaaacaataacatgagccaaagaccacatagtgtacaagggaaaaatttagtgggaaatgaggctcaagacttggtcagccaaacgcagcaaatctggaacagcatgctagggcgttgatggacgggattctataggcactagaacgttttagataaagggaatgacatccattctaattgctggggaactatggaagaatttggatgtatctcaagattcttgggttactagataaccttaaaactttctcccttgtgtgtgttttttaaatgagtttttagtttttctatggtatagagaacatacttttcaaattctaaatgttagataatttgcccgttttttaaaaaattttcttggagacagggtctctctcactgttacccaggctgtacagtggcatgatcacagcttactacagcctgtgccttcagttgatccacctgtctcagcctcgttaggagctgagaccatagacacatgccaccatgcccaactaatttttaaattttcagtattttttttttaacggagtctcactctgtcgcccaggctggagtgcagtagcagcaacctctgttcactgcaatctctgcctcccaggctcaagccgtccgcccacctcagcctcttagtaactgaattttatattttcatttttagtaaagacagggtttcaccatgttggccagcctgatcttgaactcatggcctcatgtgatctgcttgcctcagcctcccaaagtgctgggattacaggtatgtgccccgatgcccaattttttgtttgtttgtttataatagagacagggttttgccatgttggccaggctgatctcaaacttctggcctcatgtgatctgcttgcctcagcctcccaaaatgctgggatttcaggcatgagccacctcgcccagccccagctaacttttgtatttctttgtattgattgattgattggtagagatgggagtccaccatgttgcccaggctggtcttgaactcccgggctcgagcagtctgcctgccttggcctcccagggtgctgggattacagacatgagccaccatgcctggccagtagtttgacttttcatcgtaaaaaataccttttgtcaagagaattaaaaaaaaaattgtgagtaagatggctttcttgtatcgaagcttgaatgtggtcacttggttgttgctgtaacgtataaatgaacttgagtcttgaatgtttgtgggtatttcccattactaataaggaggtacaacaaagccttcaatggaagaaccagcaactataaaactaaagtcattttttgggtggatttttggctgctttctatagttggcttaggagaaaaagtagaaagctggagtatgaggatgatatgtttcctttggcaaatctgtgacatggaaattaccatgagccaaggagccagaggacatagcttgtagctctgctgcctgcaacttttaattatgcaattcagggaatagctcattaacctcattttttttgtaaaaaaaaaaaaatatatatatatatatatatacatatatatattatatatatgtatatgtatatataaattgtctaccttgtatggagtttatgagacccaaatgatttaagtgttgtgaaatactagcttttgcttcttttttttttttttaatctgctgccttcctaaaagtctggcttatctttgtgttgcttaaaggttggctaaaggcactatgattcaccaaggtgttcaagtcagaaaccttgaagtctaccttgagtcctccctcttcttcatctctcatatataattggcctcaaattcaaccggttttacttttttactcacaatcctgctccatccaccctgtattgattactttacatggaatccttctcatctgtcacctcgacccttgcaggagtctgctaactggacctacccccatcttcagtctcaccctcttaaaaaacactctcatagcacttacttgccagatactgctttaagcactttataaattccaattcatttaatctatctatttaatccagtcaccttccataataccacctagttaccgctcttgaatctggccatttttcgtacccacttaaagtcttttcctagctcccttgcctaagcattccacgcccctctctgactgccccatcttcgcaccctgtagtctagtgacattggctcttgcactgctttggacaagccattcagtcttacacgtctctgtcttctgtgacctatccctggtgctgggaaaacttttctttcctttctctccacctggtaaatgccacattttggttcagggttgtgtgtggtgtaaccttttcccattgaagcactagttggtccattatttctgtcttgcatatagttttctgtgcagagtttgtgttcactctctagactatgaagttctgggtatagggagctgtattttgctctttattcatatggtgcccggcaggaggtgtggatgcatgcttggtaactgatatcagtgagagaactttgttttcctcttaagctgctgctcttaactgtgacattaatattggtacgaaacaatgtcagaaccatcataccattcatatcactttggtatgagctgatactattatcataccattcatatcactttggtgtgagctgataatattatcataccattgatatcactttggtatgagctggtactaattatattatagcacttaaggcccaggacttacagtacatttgaaaggtagaaagtacactgcctctggctttagaaatattcatctcagtgttgagtacaaaatgaaagttgatcctgggtgtttatagccataattagatttttaaaaatcaaaaacaaaaccttcaagcctttccaaagggcctttgccaaacttatggaggctgacatgcattcttcaaacttcaaagataacacagtagatgttccaaaatcagctgtaggtaatatgactctttccttctttgatggtaacatttcaatttatattcccaagggaaagatacaaaagatcttgaggaataatcttatttacatcacagggaatataaggtaataataaagtaataagatgtgctgtttgatgagccatatagtaagttggactaggcaagttagaagggaaattgctactgatacaattctctttgggtccagttcatgtagagagtagtgtaattgtaacaggattctccagagaaattgaatcaataggtgctatctatctatcatgagattcattatagggaattggttcacgtgattacggaggccaagaagtcccacgatcggccatctgcgagctggagacccagggaagcctctggtgttgttggaaggcctgagcgacagagagctgataatttagattgtagtctgagtatgaaagcctgagaaccaggagctctgagggcagaaaagagaaatgtcccagtttagcagtcaggaagagattgaattcagactttgtctacccttttattcatttaggcctttgggctttggatgatacccacctacattggggagggccatccgctttactcagtccaccactcaaacgctcatctcttctagaagcagcctcacaaacacacccagaaacaatgtttaaccaggtgtctagatatcctgtggcccagtcaagttgacacgtaaaattaaccatcccaggacctttttgctgtagggggaaatacggaagaacttgattctgatcaaatgaagagactgtgaatcgactacatagatccctgtgggatgtgctgattttgctaatgcttttaaagccagcaatgagttgcgtgtggaggttagggaagagatcagattttcacaggttgttctcagtccattgaaaatattgatcagttaaaacagtaatgttcaaagtatgaatcataatttcttaaatcatcctctcctttgagctgggactggaaaaagaagaaatcatcttcattcaaaatactgaaaccctctgagttaatttgtaccagtgaataggattctcttcccctcaacactcatatccctaattattatttatcctctaataaaatacaaggtagttacggtgaggatgcttatagccagtggacactgaatgcctagttagaccatttgtgattctcaaaccgggttgcaccccagaacctgtgaatctgactcttgggggtggtacctggccatgtgtgtttttaacaagcttcccaggtgactcttacagacactgaatttggagagtctggtggtcttcacaactgacaactctaaaaacctactggtgcagtagttttctaaatttgtttagaacttaggatgccttttgaaatataactaacttttgggttctcaaactttaggtctgagatgggacctaaagttgcctctaacaatttcccatgtagttctaatacacacataagtttcagggactgcactagtatattgtagtattgcagaaaggcagggtttttcaaattctgtttaggtacaaaatgattcatagtcaaataaatctgagaaatgctggaaagttaaaacattgtatgtgtgtatttttttatagctttgatttttcagagcctagagcacactagggttttatagaatactgttttggggggacttatggaaagagggcaattcttgtcctcttgtttgttcaaatacttgactaaaaggatgatgctggactcgtgtatgccctggcacgctggctgaagtactgtgtgttattgatactctgcctagggatctaatttgactcttctagttatctgtatcgcagtcaggtgttgacaaagccatcttgatctctgttcttattcactgcttcccccaaacactacacatttctttgtagcatttaccatagataataaagtgtatgccttagccagtgatagatggcccctgaatttattctgggaattgcgcagaatttaatttttctatttctattttgtaaaatcaagaattctgggaagcagaaaccattaaagtcttaaatatcttaagactaatacctaattttgagttactgattttgtttaatccccacagtaaccctgtaaggcaggtgttctgatccttagtatttacagatgaggaaactaaggatgagaaaggtgacataatttagagctgagacctgaactttggtcggcttgagcctccaaatttatcatttcttttctcttcaccatgttgccttcctttcaactatataagggcagtggaatgtttactgtggaaggtactctaggactgaagacagatacatgtggttaattctaactttatatctaagtatctttgtgtctttggaaaattgacatagcctgggtctcactttaaaaaagttactgattttcttagagacacggccatgtctgtcacccaggctagagtgcagtggcatgatcatacctgattgtagcctcaaagtcctgggctcacgtgctcttcccgcctcagcctcccaagtaggcaggaccacagacatgtacagataagcctggaaatttgttttatttaggcaaggtctcacggtgttgtccaggctggtctcgaactcctaggcttgagcaatcctcccgcctcagccacccaaagtgcagggattacaggcttgagctaccatgcctgacctcactttttctccactaagtttatagtgctttctaggccgccttgtcagcgtattaggaaacacttgtgaacatggaatggggtgtgtgtgtgtgtgtgtgtgtgtgtgtgtgtgtgagtgtgtttaagataaagcaccatgtgtaattgtaaggagagaggaggtatggtgtcctcattttcccaaaaacttaggcaagttttaaatggtatcaatgagagttacatctgcaagtattttagttgctatggagtgactagcatgtgacagtactgtgtgacaaggtgtagaaacgtcatctcttgggtgacttgcagctggtgacattgcagaattcaatgataagttgcggaattcaggatctcttgtggcaggacccagaaggcggtttgatcatcaatagggcaggacttttcatacctctagtgaataaaggggaggggagaattcacgcctttgctattattgccactttacttgtattttgttcttattttgagtggctagggtaaagatcttttaactgatttaaaggatgtttagtttttattttatcagccctagttccaatgataggaattcaaaatgtaaaacttagactgtctagatgacttgattatagttgaaggagaaattttaaagcgagcttgaagaatggtgccaaagtgcatcttattttctgcagactccgaagaaaggagtgtatcctctgaggggaagttccagactggcaggtctattttggcttcaggtatgcttttctagttattgaagtgataaggttttttttttttttttcctgtctctccattctcccttttcctccttctttataaaaccagattaatattatctattatatgctttagaaataatattaaagaatggagcttaaattgaaacttcaagagctgattgattggatcggcttgccatttttggagtgagcacatgtgctggatgggagtgaggtagtgccaggacctaggagaagcacatttaagcaaatattcttgtgctgtaaactttaaaatacctgaacctggtcatctgacatggatttttttatttgagaagatgagatgtacatggggttaatatactagggaggtcagcatatgacttttccgtggtgaatttcattctgaaatgtcagtgttctctgaaagtcataaaacatgagtgcaagctgttttctgagttcatctctgatatgcagcttcttgaggcagatagttgggaattgcttagtggttcacactgatagcttatgtcatttaggtcaggaggcagagactgtcgctagggagatattggcgtaggagggacagtttgacacaggacatcacagccaggtcacagacttttgccattttaagagttgaatttgaggatgattctactttattctcgcaccaggtggagtattgctcttaagagtatgtttgtccagcttagggggtggtgaaggggtacttggaacacactcccggggatggactgtactactactaaaggaacaacacaggttggttctgctgtcaagtgatgcctgaatgatgtcctttggagaactggatgggacacaggacagactttatttagggctatgcatcatacttcttcttaggatatttctttgtatcatgtacaagaccttcccatggccccttctcaaccaaagtttctgtgtagaaaaaaaccttattgtgtaaatctaatagcttagcaaaagttggaatgcctgtttcacaaagagtgtgttgcatgtagaaaagatagaaagtaaataggaagtaaacaaaaaattatcaaggtggtgaaacaaagaaaattttttttcttttctgaaggacttttacgtctttattgtctttgctaagggtactaaggtgcattgtgactctgcagtcgggggcttagaagttaaagaactcgattacttgccagtcttattttttcttaggatggaggttgtcctctaagcaaccatttgtgtgtgtgtgtgtgtgtgtgtgtgtgtggtgtgtgtgcatgtgtgtgcatgtgtgtgtgggtattcccttctcaaaacacttgaagtgagaggctaaattatgacttaaaatcaaaattattatttgaagccatgggtatagaagtttaagagccacctggaattggagctttgttattggggtgtgtgtgtgtgtgtgtgtgtgtgtgtgtgtgttgtgggggtcaaaattttggaattaaaatgacattgctatttaatattatctgcagcagtgtttgaattagctggaatattgttcatttccatagaaactggtcacaaatgagaaacaatattattcagttttgttaggaaaaactcaagagcttgtaattttgttaggccttgattataaatactggtcttaactaattcacgcaaatttcatccaacctgtaattttttttcatgaggaatagttacctataatctcaaggtgcagctttttggaacctggtattattttttttggaaaatgaaaaagtaaaattctaataataatctcaaatgtattcttagtctctaataatagcagtgcttacaaaatatcattctcatttagctacactgaaaaatagcattttaaaaggcgttgaatagagagaatttctgtagctttttgaatggtcttgtttgaggaattggccataaaactttagaattaaatgtcaaaaaaaaaaaagaatttcaaaataccttgttttgcccaaagcagaaggaatttttatgccgtcattgtttgaatgtcatgacctataaatgaaaataaacagaataaaatcttgtttttaaacattaaacgttaggctgggtgcagtgactccatgccttttataatctcagcatttggggaggctggggtaggagaattacttaagtccaggagttcgagactagcttgggcaacatcatgagcccctgtgtctacaaacattttaaaaattagctgagcattgtgactcacgcctgtggtcccagttaggaggctgaagagggaggattgcctgtgcccaggaggctgaggctgcagttccgccactgcactccagcctgggtgatagagcaggatgctgtctcaaaagagaaaagaaaaccagaattaaatgttactgagttttaaggcaactgcatacagcagactgttgtatttgtgggttccacattggcagtttccaccaactggagatggaaaatagatttaaaaaaaaagaaatggttgcatctctactgagaatgttcgtatttttttcttgtcattattccccaaacaataaagtataacaactattaacatagcatttacattgtctaggtattaaaagtagcttagagatgacttaaggtatacagcagagtgtatataggttatatttaaatactgagtgccagtttatatcagggacttgaacatccatggattttggtattttgtaggggagtgttctagaaccagtaccccacagataccaagggatgacagtactagtgaaaacaaacaacatcaaattttttgaatctaagatactattgattgggagataagtcagtatcttaatttattatattttatattttacatatttaaaagtatattttcatatattttctgctactgccagaaaagaatatgccatttcacttggagaaaatggtgttaaatacaaaatcaagaaaaaaaaaaaaaaaaggaaaaaaatgccagcaattaactatgacacagtgctttctcttggagtttctaataattcttaaacttacagatttttacatacaaatgactttggcatattctcgatgcttgcctgcataaataatacttttgtctcagtaccttttatagcatctttttgaagacactgtaaacatcaattaaatcaagattaaaccaacagtataattttgcgttgtgcacaggtaataaaagtctgacagccacctggctgccagggttcacactggttgatgcatgagaaaaccattctggctgggtgcggaggctcacgcctgtaaacccagcactttgggaggccgaggctggcagatcacgaggtcaggagatcaagatcatcctggccaacacggtgaaaccccatctctactaaacagacaaaaattagctgggcgtggtggtgggcgcctgcagtcctagctactcaggaggctgaggtgggcgaatcacatgaaccctggaggcggaggttgcagtgagccaagattgcgccactgcactccagcctgagcgacagagtgagactccatctcaaaaaaaaaaaaaaaaaaaaatccattctaattttaaagaatttgaaatatttaaaaaatgtgtctaggaactaatgaaatatgaatttgtatttacatagttttgccaaaaacagcacttttgccttatccctctggagaggttcaggggaagagtttggggagggctttttttgtttctattgagtagcatctctggctgcttctgtcctcatcccctcccttcatgaaggctcatgatctggttctgaaggattctttttggtgattcaagctggtttgtgctgcctgttactttatcctctcctttagactctgtcttttttagtttccttgaaaaatacttgtcaaagtatttgttgactaaacctaccctctggaaagcctggctttgtcaacagctgtttaccttgtcatctctgctgtatacaatggtgcagtggacaaaaagtgttggatttggagtcaggagttctgtctctgggtaccagttgttttgatatgaacagtcgttaggtagtcttgccgggaagttctccagttcactttcttaagtccttgtggcctagaggtaggtgcttgtccagattactccacaattcctctggatcacatcaagggtctctgatgtaacaggcagacatgccctgaattctgcttgtttacctgtgagccctggcagggatgacttttccccccaacccacctgcccccatttatcagtccaaggggattcctatttaaatttactctaacaatctgttaggaggttctgactgtcactaatataagattataaatgtaaaggccttgtcacattttagaaagccagaaaatgcaatgtttttcttcccaactgattttaaagactcttcattctttctttcctttttttgctggttgttggggggggtatggagaggacattattcactaaatttgttgtctactgggtctctttaattctcagtttatttgcagagcagattgtcctgtcttgtgcccaataactgaatctgttccagcttatgtcactaacctctttttacctccaaaatgccatgatttcagtcttaaaataccaaacactttgagattgagttagatggcagataacatctaattcacattaaagaacacagcgctcaccctcctcgccttacaggtagtttggttctaggaggcgctagtgtgaaatcaaagggcaaagtaagatcatgtatagctccctaaaaaaaaaaagtagctccctactttaaaatataataaatgaagggaaggaaaaactagtttaaaagcgtagaaactgacaacaatagttgtctttcataaaggtaacgtaggctggacacggtggctcacgtctgtaatccaagcactttgggaggccgaggcggatggatcaccagaggtcaggagtttgagaccagcctggccaacatggcaaaaccccttctctactaaaaatgaaaaaaattagccaagcgtagtggcaggtgcctgtagtcccagctgctagggaggctgaggtgggagaatcgcttgaaccggggaggcagaggttgcagtgagccgagatcgcgccactgcactccagcctgggcgacagagtgagactccgtctcaaaaaaaccaaaaccaaaaacaaaaaacgtaatgcatataatctatttagtaatcatggttttagttttcttaggttagatattaagagctgaagaccttcccctcttcaccgctgcattctgtccactttgcttttgccactttttcacgttgctccccatttggcaacaataagggataagcattaaaagatctgcaacatagagagagctcattggcagatgatttccgctgatcagagtctctagattccgtaataaggaaattgcttacaataaaactcagaaactttcagctttgtatacagattcatgaaagaaaacatttgaattactgcttttgggcatcttctactcaagttgatagctgcattgagacgagtacacagttgtttgacttttcctttaagcttcttgcaatttgatttaggacagttgtactgagcgtatgttaaagcccagccattatccaaggtgctgtgttagaaatttcattaagataaggattcagccttagaaaaatcacagactagccctcggggcacagtgctggggagagtatgctctgaatccatgacctacagggtgaattaggtgattgataagagtctggacccttagatgatgtgatggtcatggagaggtactgcagaattacagggggaactgcgaaacagcccacgaactttggaagctaacatgtgtctaaagtacatatatgatactaataaccttttgtaaattgttgtaccttctccgattgtggaagttggagaatcggcagttaattttgaagcttccaagtgattgactactttgaaattgtaagtgaattcaggccttccttgggactctttaactcctcttccccttgctcactcctctccagccatggaggctcctctgggccatcacttaaaacttaccaaacgccatcttgcccaggcctgcatttgtttgaaatgatctgaagatagcttgcaaagccacatcctcagttccttctattttctactcacatggtactttctgagtgctgtgaataaaatagcaacccctccctctcctcttgcatacctagctatatttatctccaaggcacttatgaatgtcactgtctgagtgtaaactccttgaaagcaaggactttcatctgttgatgctttattagacctaatatttacctggaacagtgtgtgagtcgtaacatgttcagatatttgtgggagggtgaaaggcaggaacagagggaaaactcttcatgtattttattgtttctctctcttattagaaggtaaaagtccacaagggcaaggctgcacccctagcacttagaaatgtgctggcacatagtcaatgtttaaataaataattggagtgaaaatttgtgcaggtttggttgtgtatacttaattatgcaaccatagtaaacacatatacagatgtcctttaaaaagtagaaatgtttgttcctatatacaccaaagttatgcgtgcagtataacctgtagtaatatcggttagaaagccacatagcttattagttaagaggctgaatgcacaactgcagccgccattgctgagccccaatcccagctttacctcctgctggcagaatggtcatggcaaagttatttaactgcaccatacctcagtttccttttttgtaaaatgggaatgatggaagtacctatcgtaaggtcaagggcattaagtgagttagtataaagtgcttaaaatagtgtattaaacagagtaaacattctggaattcttcataaaaatatgttaagacaaaatatttattgatattattactaattcattcatattgggtactaaagagtggaaacgtcccctgttaatcccatagccccagatgaagatgaccctttggatctgtctccaggggagctggaatattttaaagagatgaaagcaggaagtgacagagataggattttatttcctaaggggagggtcttactccttgtattcttgccagggtactaattctttcctcttttttaacattgcacacaaaattaagtgaatccaagaaaccttccctatatcgcatagagcagctttcagtgtagttgtagtaggtagcacttaggggaaactcagtgtagagaggatatgttgtcaggctgctgctgtagaaactgcctgtagcgtgcataaagagaaagtgaagttatgtgcaaggtgagaccgtacggccatgtcgtcagtgggtgtgtcagcaggagagggacactgcagaacagatacgcagttccaaacacgccaaagagaaacacagcaacgcctgtgctataggacactggaaaaggtgtcgtaagaatttgaagaaaggggctggacgcagtggctccctctcataatcccagcactttgggaggccgaggtggagagatcacttgaggccaggagttcgagaccagcctggccaacatggtgaaaccccatctctactaaaaatacaaaaaaattagccaggcatgggggcatgcgcctgtgatcccagctactcgggagtctgaggcaggagaatcgcttgaaccctggaggtggagattgcagtgagccgaaatcatgccactacactccagcctgggcaacagagcgagactccatcccccacacctccaaccccacaaaaaaaagaatttgaagaaagggcagaatataccaatagagatggtaaaatttggacattatataaccatagaaaatatttgttcagcctcttgtatcccagaagatggaagagttagaagagaaaagggggtgggagcaatgggaggccagaacttctctaatattccctggctagattgtagcatttattacctaatcaagaaaggagagtatttgatcaaactaaattcatatttataagtatattttacctgtgcactagacaggaagtgagtattctaaggactggtggtggtgtgggtacccagctctttaacataaacactaaacaaactgtttaagatatgaaaattgtagttcttatccacataaggcatgtctactttgtgctttgtgccgccttttgctgcccagcttctgatgtccagtgcatatacactgatactaattcaacctgacagaaattcagacagaagagaatgtccaatggcatcttaagaagactccagaaaaatgagttggtcagactgtaagtgagtcactcttcctgtcttgtccaccggaaatggggctcactgatcctaccttgcccaaagaagcttctatgcaaacaatgagcatatacatttgtttgcatctaaatgtatttctatttctaaagctggatatccagtaagagtttctttgcaaattattcatttgaaatgattgtaatatgggtttattaacattgacttgcacatattacattctcatgtgagagctatcccacaagagcagcaacttagtataggaaaataaataaataagtaaataaaacaaaaagtgaaaacctgcatcatgcccctagaaacgtttgaacccctacatgggtgaaaagtacagttgttatgttggaagccagtgcctcaggagcaaatgcagactccccgactcatacagtgagtttgggtcattttccatggcactgccttgcatgtgggtgccctcttctggaatagtgaaagcaaggctgagaaaaaggactgagatttggaaggtatgcggcgggtggggctgggggcagaatctgtatgtgatgcttactaaaattttttattggtgaagactgaattttgtcttctgtgctgaacagagaaatagctcttaggaattctgctaattaggttttgtgtgtttcctttataaagagtcttaaatcataagaggctgtcccttccagggaatgtattctatgtaactgttgaaaacaggttcatttgagacgtttgtcctaagtattcctactgagcgctaactaacatttgtatggagatttatatttaataaagtgctgtcatgtattatctcacgtcatcataaccttaatgatgctggtggtgttggtgacgaagatggatctggtgataggagcagacgttttttgtttaccgtatgccagacatcttacatgccaagcatcatacatggatcttctcatctcatcttcacaacagcttgtgaatatgatactattatctgttttatagctaaaaaccttaagggttacagacaatgatgaccttacctacctaaggtcccagaactggtgaccactggagccagtgtttgaacttgggtggtctaactggagttctccagcagataattgcttttggcatcttctaaattaataatcattgcttgctggcaaactgaacactcacaggtagaatttcctgaacaaatgaagggagacccctgaattcttctgttgtaacagaattcaaatgaatacactactgctagacatatttctttggcgcactttggtgttctttggtcatgttgagtgctctagcctctcccaggtgattccctccaccaacataagggtgactagttcacatctactgaattcttgcagacaggggatggttgccattgctaccagacagctctgcctggttaacctgtgtgtaccttgtacctatcgtttcttcgaaccaaactcctggtcttccacgagtgcttgtttctttccatgtgtgcacactgttacccattccctcttcttcctcttgtgttcattgtcttgtttggtggcatcaccttccaccagcttttaagtcagggttagtcttgtacccacccttgaacatagctccatgcacatctcaagccactcatcccgttcttccattttaccttctaaatagctttcggaggaggcttttccttcatattcacacagacacgcaatttagtttctcatctcttgactgtactattctgataccttttgtagctggtttttctgtctcaattttgagtccctgcagttttccctccacaccacaagcaaaactgatcttaccaaaacccaagtctgattgttgttcctctctttagacctatagtgacttcctgtgtgttagaggggtaactcaaagctctgacagtgcatcaggatcatcttggtccttaaacagaagaatgccagggcccaccgcaggccagcgactgagaattccctgcagtgcaccctggcacgtgtctttcctgaaatctccacgtgtcctcacatcctacttggatagccaatggacatctcaaggtgaacacatcaaaaatggaacttctttttctcacaacctgtgttaactttggtctttcatgtcttggtcgatggtaaccccacccttgaagttgctcaggactaaaacttaactactattctctcagccctcccaaaggaccagttggcaggtcctccgggacctatagcccctactgccacccaagccagctcctccctggcacatgcattaccccctgactggtcaccctgcttctccagtctattttcaaagcaatacttagagtgatcctttaaaaatataaattaatgttagatctttactcagaacccttcaatattaaccatttcactaggagtaaaaaccagtctccatagtggcccccaaggcctttaaacaacaaagtcgttccccaactctgcagaggtgttctggggcattgcagtgagctcacaggtgtttctcaggatatttaaattgtcaagggaaacacagctctcctcatcatctgtcaaacatcatgtgaacagctagttcagcgtcaacatcagattgtgctatattccttttgacgtcatagctttgagctggattttcaccagttgttgtgataaaaattaagtgctatgagaaaacaaatgagtggcggtgttcagtctgatccgagatttaggaagtcatatggcccagaggcacacacatctattagtaagcaatcgttatttaataataaaaatgatttttctttcaatttgtatgtattgttttttcaaatgactgtaaattgttgggtccaaacttaataagcatttatacactattattctgttactaaatggaatatatttcctttggccttggagtgtcataaaaaacttacatattaaagactctgagtcgagaaaatgtgggaacctccatcccacaagcccatttgctctctgggtattctccgttcactgcctctgccccagccactctggctttcttgcttgccctcacacatctaacatgctgcagcctttgggccttctctgggcttggaatgctgttattttatcatatttgcaaggcttatctcctttacatcttgctcaaatgttgccttctccatgaggcctaccatgaccacttcgtagaaaaatgtttccaccctcatccccaaattagggttcctcttctatctttgctctatttttttccagagcaaacgtcaccttctaatatgtagaatttacttatttattaaattctttatttttagctcccctccccacccagggtagaagtttttaattctgttttgcttactgtagtctaccaagcacctaaaatatgtggcacagtatagggaattaaatacgtattcattgaatcattgaagacagacataccagaagatgactggcaggagcaaaatggatagtagtaaagcttataaaagtagtaaagcattggagtctcactgaccatgtccagctccttgcctcagttttcccatctgtaaaatgggttatactattgcctgtttcataagactgacaattcaatccctaggaagaagcccagaggctggcacatagtaaatgcctaaccattgttaacctattaggtttatggtaccatggtgggtgctatggctcttctgaataacttctcatttacatttctttgggaattagatgatgtgctctctacaatgcctaggaaataaatgccatagataatgatggacaaaattattttcttttcccttttcagaggcaatttatgatttagggttttacttattttttgctgatggtgtacttacttctgacttgtatttcagccctggaagctgtgcgtttgtacccgccctcttgtctgttggttccagtcttctgtgtttctatgtcatcagcctgaagaatggcaaaggagtcatgttgttcccactggtctttttattccacttgcagctgaagtcatttcttctcactccttgagattcttctaatttgcctttgcctaagttatgtataaaattcaactcgactaggtggctgttattattttctatgtacaacccttggggtacactttataaatacagggtcatacagggagctttgacaccttaacctaacttctttttggtcctagttttattaccacaattacataaaaatttaaagaaattttaaatttaaattcaaagtatactattgcctgtatgaaacgggcaatagtatactgtttattaaagttctgggaaaaattgaaagtaaaacagtacactattgagtatattgttttatacaggcaatagtattctactgatgtcagtttttttccaggattagctacagtgaattggaaaattagtgccacataccattattgatagcatagcatggaagacagtggaggaagtagacatggcagatggctgtgttcttgcattctcttagcagatggctgttgagtaccttcagccgccccttgtgttgaggattcaaaccagaattcaagacagtggtaggtgaaagcgatgagattttaaaagatagcactaagagttcacagaatttggcatggtagggctgggggtgatgagtgtggcaaagggaacaacatacgtaaaaggcatgggagcacagcttgtatttgtgtggttcaagtaggagggaaatggtagaggacaggttgaaaaaagaaattggggtcagcttggaaaaggccttaggacatgctacagaatatggatcttgtgtaggatttgtgtaaagtggctacattatcacatttgtggtggtagcatgcaggtcaagagagaaggatgaaaacacagaggagggtttttgtgtttttgtttttgttttgttttttttgtatttagaggacgttagagaagaatcagtagattataggcaacaaagtcttgataaaactgtagaaaaacagtaggaataaaatcgcagaaacaagtgaaaaaatccagaaggattctaattgtgaataagctaccagttggcaatcatggaacaccattattggaattcttgaaataaagtttagaaaaaaacatttcaggaagttttgccagataaaatataagatgcctagttaaacttgaatttcagaaaaacgatgaataatatttttgtataagtatgtcctgtgcagtatttgggacgtacttacactagacactgttttttgatgtgaaattcaaattttattgggtaccctatttttatttggaaaatctgccaatcttagtatgattcaaaaggttgtgagaaggcatggtgatcagagtcaatgatctggtccttcatttgatgatgcagtgttttgatgagagaattattaccatgtttacttggaggtcagaaataaaggccccagggaagcattttctagaacacagggagaaccttttgggaagtctcttacacatttaagtgactggtagggatttatttatttgcaaccttactaggctgtaaagtgatttgatcaagaaaaagagggaaaataaaacaaccatagaaaagagaaaatccaaactacagaacgcatctaatgctcagcagactagagctgcaatgtcttgtgtattcaagaaaacaaaatggggtgttatcccctccgagagggatcactgagttggctttatcaagtgtgaacgaggctgggctcactgtttcttacgttctcgatagacagtggcccttgtgttctggctgctgtttttattagaactgcagaaacattacagaaaccgcaacaatgaacactcggctgagaatgtgaggtcatagtagtgtgacctcacagggagccaggttcttggaaggctgtgaggctcggcagtcactgaacttgggagctgaagaatactggacggggcttcggagaggaaggatggtccaggcgcaccccaggggttgcgatgggctcttcttggtgtctgtatggttgctggtaagtttatattgccatcatattgtcaagctttctgatttaaaaggagcaattccggttcttgttcaaataatctcctaaactgtgaaatggacagaatgaagccatctagggacatatttatcctttgtgctttattttctccttttactgaaacctttttgaagaagatccagaaagtctgatgcacacagattttgcaattatatggttttggtgaatgtgaggaaaattaggtgaaatcatctggactgggcagcatagtagaaaaggggcaaatatggagaatgagtaacatgaggaatggaatgattttgggtaataaatttttaaaatgtgttctcattagaataagcctcttgtatttgaacaaaattgggccagtactgtatatgtggtataattacattgtttgcacagaatgattaaataaatgccatgaattttccctgggaaatgagcagtgagtagtggtttaattaagaagaaaatcctttctttgacatgtgtttttactacatgataggaaaagcacacatggaaacacaactccaagggctttgttttgtgttttgtataattataaaaagtacttgattgtaattaacgtagttcttggaataaatattttacatttctgtcacttgtatgggaaaacacaaagtaaccatgaattgcctaaaagaaatttctactgtgagttttcttattataggttatactgtcgataatgattattcagtttcctgatgggatagatttcacaaaactgaatggtagtgttaagtctctttttaaaaaaatgtttacatcatagacaggagggtctcaccgtgttgtccaggctggtctcaaactcctgggctaaagcagtcctccccttggcttcccagtgtgcagggattacaggtttcagccaccacacccagccatgtaatgttaagtctataaaggaagatgtaggatgaaaaaatcatgcatttaaaaatgtattttcatggagattttatcataatgaagcaatttattttaactggtaggcatgtgtattgggaaactgttcaaggtgttgagggttaccatacatgttagtttgcctgggtcagttccagttaatgcctgctgttctgccattgatattgactgtggtttggtatttgacttagagttttaataactgaactattaccattaatagctatggcaaaataagccagcatgggtttggtagacctaacttcgtattcccagcttctcccatggtatcatctgggaatgtgtgagttgacatttttacacagttgagtctaaaaaactctctctcttttccctattcttagagcttcatttcaagggcaggatgtcaggtgcttgccgataaagtgtgcttggagaagagttgctaaggacagttaactccttctaatcctgtggtggttgagggagtatgagactttgcagctacttgttataccagctggttgtccaggagccctggctgctttttcagtgaccttgaagcataaggccagtgcttccttggtagagcagtgggaaaagggaacttgtaaatgaggtagaataagtgacaagatggagcagttctgcttagaaatgcatttatttttactacaatggtttttgtcatttcgtgatgtaagtttacaacctattttttaggttcagatttttaaaaacataacaccattgagataattgaaatactgtatcacttgctttattaaagtataaaatccggtggtttgggcatattcagagttgtttagtcgttaccactgtcttaaggatgctttcatcaccccaaaagaaacaatgcccattagcagtactgcttttttattgataatgccttctttatttattttgtaatgattataatagaatatttaaggatttattatctccgtttcccctttagagtgtcctggtttagacagtaaatggttattgtgcttaatgcaagccaagttaaagaactatgggatagagcaagggcagataaactcccatccatgggcccaattcagcccagctggcatggctcttaggttttttaaggttgtaacaaaacaacaacaacaaagcagcatgtgtgacaggggccatatgtggcctgcacgcctacgatatttattatttcatccattatggaaaaattctgaccgcccttggtttagcatctgtggtaagtgtgttcgaaggccgtgtaagcacattttattatgagcatgtcttacttccaagttaagataaagatttggaaattaatgtatcctcattagtttcactgttataaatacaagagaaccctctatacctgaccacaggctgtagtctttaagccctttctagggcggagttctcaacgtgttgcctgtggagctttcttccttcagttaggtttatgagatcaaaattgttttacactaattattataacactatttttgtttttcactgcgttgatatcttatggtgcaaaaacaatagtggaggtcttagtagaacttaaggcagcggcaccaaactcttctagtcatcgtattctccactgtcatgcactcaaaataaaaatataggccagtttcacctttaaaaaaatccttgatgaaaccagtacagtttatttcatttcagcgcttgagatcatgtctttttaattttgtgtgtgatgaaatgggaataaagcacttctgttcctggtagtctccaggaaaaacattcgtctgtcatttaagttggggctaaaaactagtcacttttttcattgaatgtcatttttccttgagagaatgactgacaaactatggttattggcaaacattttcttgaaaatggagtaagcctattactttaaggaaaacagctgataataatttgtagcaaatgattacatttgagcttttgaacaaaagttaggattttggaaaacttgtatctgcccgcaaaggtttggcagcttcccaatacttagacttttcattaatggtgacattagtgaatatgatttttttaaggttatataatgaaatgtgtcaacacatgttttgcagataaccaatgtgtgatgttacaaaatcatgtaagggttaaaagatccattcaaagtataagatagattttaatataagagtacaaaaagttaatcgacacaaatttagattccatattgcaagtaagaatatcctttaagaaactaccacttgtctcactttggtgttgtatcaaaaaagaatatccacaattatctgaaaaggatattaaaatatttcttttttccaatgaaatatgagtgagggcacattttcttaatgtgtttcaaccaaaataatatattgttactgattgaatgtagaaatggctcttagaattcaactgtcttgtagtaagccagctgttaaagaaatttgtgttttaaaaaaacagtgaattttagttcttctggaaaacaatagttgtatctttatagtatttgttatgtaaaacagatttatttttaagtgagtgaatttttaaaatgtttctattttcattactacgagggtaaatatcggtaggtataacccacataagtgaaagccgtatggagtccttctaagaatgtaaaggtctagagactgaaaagtttgggaactgcttgcctaagatttaggcaatctgttctttagttctttaaaatatggtaactgaaaaaatttttatgaatatttaaacatacagtgatctcatctaagtgtagctgaactaaaagaaaactatcaatatttcatcagatattttcctttttgccatataagaaaaatctattattttctctctttatcaattatcatagcaatgctggggtgaaaacaacacggctagaagctcattctgaaatggggagcactgaaattttggaaaaggagaccccagaaaatctcagtaatggtaccagcagcaatgtggaagcagccaaaaggttggccaaacgcctttatcagctggacagattcaaaagatcagatgttgcaaaacaccttggcaagaagtacgttctgacccattgctggagtctgaattctctcctgttttgtgtgtgttttaaatagtttacctttcaataaccaagtctattctgttttcttatagcaacgaatttagcaaactagttgcagaagaatatctgaagttttttgattttacaggaatgacgctggatcagtcactcaggtatgactaagcctccttgctgctcgtcattgctttcaaatgattagttcttagagaagaaagtaatgtcttctagctagaatcttattttttttttttaaacctccatgtataggtggagtattccttctccaaaatgtttgggtccataagtgttgtggattttggattttgtcaggtttagagatgtttgtgttatacttatccaagtgaacatcccaaatctgaaaatctgaaatgctttagggagcatttcctttgaaccttatttcagcactgaaaagtgttgtagattttggagcatctctgatttgaagcattttagatttcttatttttgggtttgggacgtttaacctgtagtttgtgaacttagctcaaattgtattatagatattaaacacagcaaagagtaagaaaaacgtattcatttaacgaaatgacacatgaattgatagtctacacctactggtaagcctgagttcaggtggtaaacaattggtagcaaagcaaatctggataaaaaatgccatctgtaggagtttttctgtttttcgtttttttatcgtgttagaatacagatagcataaaatctttcatcttagcaatttttaggtatacaatgagtggcattaaaaacattcataatgttgtccagccgtcaccaccgtccatctccatgattctcttcttgtaaaactgaagctccatactcgttaaacaatgactttttttttccttcccctcctttcccccagcccctggcaaacactattctacttctcttctcgatgattttgactactgtaatgtaaattgatatatacattatttgcctttttgtgattcatttaacttagcataatgtcttcaaggttcattcttgtagcatatatcagaatgtcttcccgttctaaggctgagtaataccccattatggggaatatatataccaccgtcagcttcaggacacgcttgggttgcttccatgcttttgctattgtgattaatgctgctgtgaacatgagtggacaaatatttcttcaagaccctgttttcaattgttttgagtagggagtttggtttttgaatgatgagtttaacacacacacacacacacacacacacacacagtttatagattgtagaattagaattagatttttttcctaagtatttgcttattatatttgcttactatagcccaatagccttttttttttttttttttttttggagacagagtctcgctctgtcacccaggctggagtgcagtagcaccatcttggctcactgcaacctccacctcccaggttcaagcagttctcctgaatcagcctcccgaataactgggactacaggtacgcaccaccacacctggctaattatttgtatttttagtagagatgaggttttgccatattggccaggctggtcacgaactcctgacctcaggcagtccacccgcctcagcctctcaaagtgctaggattacaggcgtgagccaccgcacctagccccaatagccttttaaggtgatactttggaattaactcttcagtggaataaaaatgaatgtcagcataatcagtagaaagtatctataaaactgtttgcaacaatatccactttttctgaccttttcaaatgaaggtgtctaaaactcactgattctcactttttacattatattgtattacaagtttctaagtagctgaaggtaaaacctagtcagcatttaattttcaacactatttataaaatgtccatgtctggaagaattctgagatcatctagtgtaaccctttaattttacaaatcaagaaactgaggtctgggaggtgaagggaggatgtttggactggagtgtagtactgcagtgatttatcgtggggctcttttcatgcagcaaaggtactcagattttctaacaaaaacagttatcagtggatgaaagatctgtatttttgccttgcattctgatgtagtttattaaagttatgaaaaattaaagttttgtcaatatatagtttgttaatcttaattatacctataataaggaagaaggcaaaattttcatagaaatgaggctcatggtatgttttttaccatagtaagatttcttagacattttgaatgattttttttttccttcccatctcatgtttaggaaaatgaatctacattgtcaagtgagggtcatctggattcatctcaaataaacagtgctcttagtgactccgagtagattaatgtgtggtttttgatacacttcctataatttaaagatatttttatacataaactaattccattatgtaaggaataaattacttatatctcccaatttcctcctcctataacaaattaatattaaaatgtgataacagacacaattaacagaaatctcctgtgcacaaagcaatgcaatccatagtggctttaatagagatgacagtcatgtaacaaaatgacagaagcaccctgatgcgtgtagagttttaaaacatagcctttatgatgatgtattgagtcttaagcggtctttgttttttttaaatctgaccttttaaaattggctacttgacacttggtcataatgaggaaattacctaccttcccaaggctttcttgatgtactgaccactctgttatcaccctgtcatcttttaagtggacattttttttttcttttgaaacggagtctcactctgtcgcctaggctggagtgtagtggcgcgacctcagcttactgcaacctccgcctcctgggttcaagcgattcctgcctcagcttcctgagtagctgggattacaggcgcccaccaccatgcccggctaatttttgtatttttagtagagatggggtttcgccatgttggccaggctggttttgaacccctgacctcaagtgaacacctgccttggcctcccacagtgctttttatagaatttaaatactaataccaatttatattgaatggctgtctagtaaatgatttttttggggggagataacttcataatatcttactttgtataattaatatcttaggtttatataaattgacttttaactatgaaagagtgtgatagcattttcgaaaatttcactgtttaaatttttaattctcttgtaggtatttctttaaagcattctctcttgtgggagaaactcaagaacgagagagagttttaatacacttctccaatagatatttttattgtaacccagataccattgcttcacaaggtaatctgatacaaatccttgaatttcttttttatatcaatggttattttccttattatgaaagttaaattttattgtgagaaattatgtatcttcagttacctagtgataactattaacacttctgtttacttcattctagtctatttaatatttaatgtcaaattggaattagagttttgtttttagctgcctttttatttcattgtgagcattttctcatgtcattaaatattctttaaaagcataatatttaaggacagcatgatatcctctactcttacttaaattattttgttttccacttctctagtgtgacagcgtactttctttaaattgttcatggtttgtcactctgagattttatgtaatgaatgaaatttcagttttcttatttcttatacatttggtctctatgtttcttgatgaaagctcatgtatcctgagtgttggagttagttttggaaaaattaacaaatctcactggtggttgcgctgtgtctctggtgctttcgtttgatattaattgtactatactgaccacaaacttttgttgatgattttaataaactatgaggttatgcatattacactatttttacaaagtaagtgacttaatggtaaactgtttgtttgtggacctaccttgtgaagagagatctttcctccatttcagttcctgcaataaagtacacttttcagtgtttgaagtgaagcactttgacttgtgactggaaaatgtttcataaacttacagatgatggagtaaatcactgagactagattcccaagaaatagtaattacctcttagcttcagtattgccagttaacctggatagtttacttggtattggccaaggtgcttgcctcaacctcccctccatgtccaaggctgcagtcacagttagtttatcacctgattaaggtcacattcctatcggtaaactgatgctattcagaccagttattcactatctctgtcaccattagccctgacaagagaatgaaggagataaaagtgggccatttttattagaaccttcttcaaatctaagaatatgtttacattcttggataaaataagaaatatggattcgtgacttaattggctgttgatgaggatatttgagagttggctgctgagttcttaaaatactttcgagaatttgttttaaatatatgtagaacttgtgataataaagtggtactagaataaatatacttttagccatttggtagtgtctatttagagacactgataacagaaatcacctactatactaaagaacttacttttgaaaataccctggctttaatttatgagtgcaataattagaccttctaatttagcgtaaattgaaaagatttttactgcatctgaaactgctattgtctactgtacttgtgtagagaattagcagagtgagagtaacgagaacaactaattgtagtgtttggaaaggagaatcttaactctacttggagaacatttttatatgactttaacctaacagtaatgtgtctttggaggctcatatttacttgtctcccattgtaagcaatgcttgtctggatatccttgtactatgtatagatcactaattattgctgtagtgcaaagccctagaagccgatttgttgtatcaaaagacattgtttgaaggctttacatatctactaccaaactgtcctccagagaggtaagaacaacttatcaacagtggagtccagttctgtgcattgaggttctttctataaattattcttatccattttttgtttcttaaaacaggactaattgtacctagcacagtactgttttcataggttctgagtgtatcctattagtgataataaggtggagtccaacagtgaaaagcgaattcatgcttttttttcttgtatctttctttagatggagtccattgccttacctgtgcaataatgcttcttaataccgatctacatggccacgtaagtgtggatttgtgaaacttagatccaaaacatgtcgggcttatctctgcttttatgttcaaacacatttattttctgcctccccgtttcccattctctacatggttcccatggcaggtgaataaaaagaaatctttgaaaaaagaaataatttttttatttcacatgctagcacagagtatgactttaaatccatcgtcctggtgtctggagttgttttagcagtaatgtgtgtgttctgtgtcttctttgtccagtagatggcagacagagcttttacttatttttgttttctggttgagaattacagttgatagataatgatggagagaatacaaattagatctgaaaatgtgaattgtgttttccctacataccatagtgagttgaataactcagcctttcttgtgcccctcagcttatctagtcttttactagttgaaataataaaacaaactaattaccgtctcatcatctacttaagatacaagataaagtgttaaaatgtataattatatataaatttgcaagttttgtagaagtagaattttagcatttactcgaactcttcataatactctttaaaataaatgaacctgggactatgaagtaatttttgctctaagtaagtatagattagtccatatttaacgaattctgattgtattttgaagagaaaatcaggtgtctgtgtagagtatattatcccttgatttgccgtaatatatcttacaatttaaaaattacatataaaaaattgatatttagatattctgctagtcacataatttccttttttggaaaatatagtgttcccttttaagaaaggaaccatggagctctatgggaccattaagttggactagctgttataagaggaaggggttcagggagaaagggttccaccaccagaaagcaaacaggagatatagtgatagaatcctaattttaacatcattttaacatatctcaaaatactcagctagaaagttccttttgccatatataagaggtgaatttagaatcacttagtggcttgtaaacataggtagcacgtgtccagagataatacagatgaaaagaaaatactttcaggaagcattcttgggcagtatagcacggctaatacaccatgtggaaatgcaggcatttcacagtgtgaatcttgacatgactaccgcaatctaatgttcatccagcttgttaaagggatggccagtcagtggattgtcatgaccacttttttcgtgttactggccaagcaagttttcactgctttgtctggctgtttggtgataacagttgctctttgcacccttcttttccttagcctttctggccaaaggagaaaattttgagtgcgtttggccacatataacattgaatcaagtcagtgatcaccagcgtgaagaattcccttcacactagatattttgaggttccatcaacataaaagagttgtacgtttagcatctgttaactgagaaaagtttaatggtgggaggaaaaaaattcagtaatattgcaatttctctttaaaggttgcagatctcttagagcttttgtcacatttttgatgatttgtttctactaaatcctagattgcatttttaaaaagctaatatagctttaataatacttttacataagcatgtatctgaatcataagaacttgaaatgtagcaaccaataaagatgttattttttattagatatctcagcatgcttgatgtctagatgagctgtggacacccaggtttcagtagctacaggtttagagctgcaaatctaggacatttgctcttctttagacttacaaggaattgtaaggagattagatgaagcatcctgcttcttcttggcaactgggatggaaaagagtttacataaattaacattttaatattaccttgagttaggccaatcatggataattaataattggcagtcgtggcaaaattactgatagaagagggagaaaattatcaataacagtgaatctctgtcatattcaggatcatgtgtttggtgataagtagttctctgttttaaaaatgtgtgcgatatacttgggattgtctatttaggttttatgtattagttttccataatgcatgctgttacaagtctgttgaatatatagtagctatcataagaactaaccatgtaaatatgtttcttctatctttctcctctggattcattttaaaaataaattattcttctaggtggtaagtttttaatccataattctggatgtagcttctcttgcatcatgattgcctgatttttttgttgttgttttagtgtctgtttgacttgtcagcatggcccctatgaaatcgaatcatgcaggagataaaatgaattatttctactgttctgctccttttcaccttctccttaatgctatactacctagaatatgaccacccattacttgatccgatgccagaataatcttcatggggaatacactaatcaaccattattctttttttccttaccgttgtgtcataatagcaatactgcagcatgatctttctaagaagtgccaagaccagcttgtcctcatatgctttcagtaggggaggggtgactcccctatgaggaggtctgactcccctcttgggagattaacttgttttggctgctcttggtgaacctttcctttactctgaggaatgaggcactgagaatgcattaatatgggccttggtttggcctgctaatttccttactaataaaataatggaatgtatactaatattttacttacatttagctaatgtgacatgttgaaatccctttctttttctaactttccccttcaacaaacatgtatatagcatgcgtgtgcctcctcctttccatactctttgccatttgggtaaggatcagaggtgaatgagacaatgttcatggaagccaaataatcctctctgatggtattggctaggctgacctcattagtcaggtttcactgaagacatggtagcaggttgctgaggtgctatgatgggaaaacactggggaggtgttttaatttcatgttggatcatgttaaacttctctaattaggctagataaaaaacaatctgaagtatatacaatatttggggggagaattcagtacctgcttttaaaaaaatgtgactgatatatcattttcctagcaagagtatctacttgtttttacttgtctgcaagtagtttattcccttaaattaaatattttataattgtagtcgtgtggtgaatttgctatataatttgttttatttttgaaatgcctctttatctacaaaatacttatgtaaattaaacttctacacatacagatacatttctcttaaactctagagtttctttctttgctatattggaactaagttttattgaatattgtttcaactatcaacaaggtaagagttgaaagtctttttcttcaaccttgtttgaaatggtatggataagatttgatatgtcagaataagtttatacttactccctttctggatggatcttcaaatgcgttctgtttcctaccactaactagcttgcttgtacttcagtcacagtttagtcaggttcctaccgtcctggcaggattatcacccagggctggtgttctaaggtggtaggagggttaagtatagaattgcatagcagtgaggagtgagatagatcagagcatagtcagctggccagttccacaactagaaagtcacaagagatacacaagtcagtggctggccaaggtcaggccatggtaagaggcagtagccagggcattgtttttaatcaagattttttgacaaaatgtaccttttaacatcaaggcttgagattttcagtagcagttttgtccagcatccctctgttctccagtattggcagaagccagcccaccatgtacaattggtataagagcctggttgtggttcttagaggtagctctctttctcgggctgggcctcctacatatactttacccttgacatactcagagcatgttgagtatcatgccctgtggtctgagtttaatgatcaggcacgaccttactaatgtttttagtgttgggttgtaagtttggaaagggttgaaaccatatctagtacaacttactggtagggagaagaatataatcaaggaagaaagtatgtttaggttttgtcacagaacagtgttaaaaaaatgtggagttcagtgtgagatagattgtaagaattcattatttcttttctaatctataaacttaattattgcattggctttctaggagcctagaatcttaaatagtggataaatatttggtttattagtagtggaaaatgactattataaaaattattttaaaaatttaatgcttcatgtaggggtgggttgcccctacacacctgtgggtgtttctcgtaaggtgggacgcgagatttggaaaagaaaaagacacagagacaaagtatagagaaagaaataaggggacccggggaaccagcgttcagcatatggaggatcccgccagcctctgagttcccttagtatttattgatcatctgtgggtgtttctcaaagagggggatgtgtcagggtcacaagacaattgtggggagagggtcagcagacaaacacgtgaacaaaggtcttggcatcatagacaatgtaaaggattaagtgctgtgcttttagatatgcatacacataaacatctcaatgctttacaaagcagtattgctgcccgcaggtcccacctccagccctaaggcggtttttccctatctcagtagatggagcatacaatcgggttttataccgagacattccattgcccagggacaggcaggagacagatgccttcctcttgtctcaactgcaagagacattccttcctcttttactaatcctcctcagcacagaccctttacgggtgtcgggctgggggacggtcaggtctttcccttcccacgaggccatatttcagactatcacatggggagaaaccttggacaatacctggctttcctaggcagaggtccctgcggccttccgcagtttttgtgtccctgggtacttgagattagggagtggtgatgactcttaaggagcatgctgccttcaagcatctgtttaacaaagcacatcctgcaccgcccttaatccattcaactctgagttgacacagcacacgtttcagagagcacagggttgggggtaaggttatagattaacagaatctcaaggcagaagaatttttcttagcacataacaaaatggagtctcctatgtctacttctttctacacagacacagtaacaatctgatctctcttgcttttccccacagcttcatattgtgctattttatattttcactgtcaaaaacatcacagacttccatgatattgatgaacctcatagagttaatatcctcaagaactctctgcatctgtaatgatcactattgtaactggcagctgttaagtacatttgcaggctatcctctcatcgtcctgcaggataatatcttccctgtggatacctcttctgtctgtgcttctctgtatctgtgatgccctctgccttgaaaggtgatgccatctgccatgaaagctatcgttggcattcagttttctctctgagctttcccctgctgtagattccatccatggtcataatttctactgtgctagcactgccttctcctttggagtcctctctcctatctccttggtgccgtgtttgtcttgtcttacctggctttttttcctaaattattatttgcaaagatcttttgatttctaactttaaggtcaggggtctatgtgcaggatgtgcaggtttgttacataggtaaacaaatgccaacgtggtttgctgcacagatcatctcgtcacccagttttgttttgttttttttttctattttgataccttacagagttatttttttattttttattttattttgttattatactttaagttctagggtacatgtgcacaacgtgcaggtttgttacatatgtatgtgtgtgccatgttggtgtgctgcacctgttaacttgtcatttacattaggtatatctcctaatgctatccctcctccctctccccaccccacgacagggggtgtgcaatgttccccaccctgtgtccaagtgttctcattgttcagttcccacctatgagtgagaacatgcggtgtttggttttctgtccttgcggtagtttgctcagaatgatagtttccagcttcatccatgtccctacaaagcatatgaactcatcatttttatggctgcatagtattccatggtgtatatgtgccacattttcttaatccagtctatcattgatggacatttggactggttccaagtcttcgctattgtgaatagtgccgcaataaacataagtgtgcatgtgtctttatagcagcatgatttataatcctttgggtatatgcccagtaatgggatggctgggtcaaatggtatttctagttccagatccttgaggaatctccacagtgtcttccacaatggttgaactagtttacagtcccaccaacagtgtaaaagtggtcctatttctccacatcctctccagcacctgttgtttcctgactttttaatgatcaccattctaactggcccatcacccaggtattaagcctggcattcattagctgttcttcctgatgttcttactcctcccaccctccaccctctgacaggccccactgtgagctgttctgccccatgtgtccatgtgttctcatcattcagctcccacttacaagtgagcacacatggtaattggttttctgttcctgccttagtttactaaggataatgacctctggctccatccctgtccctgtaaaggacatgatctcattctctttttgtggctgcatggcattccatggtgtatatgtactacattttctttatccagcccttgatgagcatttaggttgattccatgtctttcctactgtaaatagtgctgcaattaacatatgcatgcatgtatctttataacagaatgatttctgttcctttacatatatacccagtaatgggattgctaggtcaaatggtatttctggttctaggtctttgaggaattaccatactgtcttccacaatgattaaactaatttacactcccaccaacagcgtaaaagcattcctttttcttcacaacctcgccatcatctgttgttttttgactttttaataatgtagccattctgactggtgtgagatggtatctcattgtggttttgatttgcgatattgatcagtgatattaaggttgttttcatgtttcttggccgcatatatgtcttttgagaagtgtctctttgtgtcctttgcccactttttaatgtgattgtttgttttttccttatacatttaaattccttgtaggtgccgggtattagaccattgtcagatggataaattacaaaatttttctcgcattctgtaggttgtctgttgactctgatactttcttttgctctgcagaagctgttcagtttgattggatcccgtttgtcaatttttgcttttattccaattgcttttgacatcttaatcatgaaatttttgcccatgtctgtgtgcagaatggtattgcctatgttttctgttagggttttattggttttgggtttcacatttaagtcttaaatccatcttgagtcgatttttgtatatggtgtaaggaagggatccagtttcagttttctgcgtatggctacccagtttttctagcaccatgtattaaataaggaatcctttccccattgcttgtttttgtcaggtttgctgaagatcagatggttgtaggcatgcagtcttatttctgggttctctattctgttccattgatctgtgtgttcattcttgtaccagtaccatgttgtttgggttactgtagccctgtagtacagtttgaagtcagacagcacgatgcctccagcttgcctctttttgcctagcattgctttgactgtctgggtggttctttgcttccatatgaattttaaaatagtttttttctaattaaatgaagaaggtcaatggtagtttaatggggatagcattgaatctataaattgctttggatagtatggccattttcgtgatactgactcttccagtcttctgtaagcatggaatgtttttccatttgttagtgtcatctctgatttttttgagcagtggtttgtagctcttcttgaagaggtccttcatttcccttgttagctgtattcctaggtatgttattcttttgttggcagttataaacgggagttcattcatgatttggctgtcggcttgacttttggtgtgtaggaatgctagtgatttttgcacattgatctttgtatcctgagacttcgccaaggttgcttatcaccttgagaagcttttggtctatgtttttacctgacttggagcttcccagacacagtggccccaaggccgtcatccctgcagcttctcggtggtcctaagagaaggatcagggctagatctcacagttgcagagggtttctagtggggcctggcgttcattttcaccaatactctttctgtctccacaataaggatatagagaatagcctgagaacctaaccattaggtgttgaaatgtttttatagaagaatgttggccaggcgtagtggctcacgcctgtaatcccagcactttgggaggccaaggtgggcagatcacgaggtcaggagatagagaccatcctggctaacatggtgaaaccccatctctactaaaaatacaaaaaattagccaggcatggtggcgggagcctgtagtcccagctacttgggaggctgaggcaggagaatggcatgaaccttggaagcagagcttgcagtgagccgagatcactccactgcactccagcttgggcagcgagcaagactccgtctcaaaaaaaaaaaaaaaagaaaagaaaaaagaaaaatgttatgatctaaaaatgatgaattgtaaattgaaattgagaatataatttactatcatattgccaatggtctagactttaataggaatccttatctaagtatgccatagtttaatcatgcactggtcaattttgttggattctatgacctcttagaatgaaagccttctttccttttttccatcctctgttccttcacctgtcccctttccccaccctctagcctcccacttttggtagttttgcttttttaagaacaggtttatatatggaaaatacctcagggtagctttaatcagttgtgtcagtggggcttattgagggacctcatattatctaacttacacattattcagtcttcttatcactgtaagctttttacattggcacagttctgttatagaacgtgatcaaggaaagcaggtcaaattctaagtcagtttcgctctttcttactttctgcaaattgattgtggaggaaggagggaggaatgaggatgatggtggctgaaacccctgactcttgtttccaatcctgttgcttactttaatgccagtcctgctacagcaatcaagttaaaaattgtttggttagtccttgtaatttgacagtgagttaggtgtgtttatcttttcaaattttaggggaagtgctttccatgaaatatcaatagaagtctgatatttcagtattctaaaactttttggtcccaggatagctttatactcttaaaatttttgagaagccccaaaatcttttgtttacatattaatatttatctggaactgaaactgataagatttttaaattgcattaaatcattaaaaacccattaagtgaataacacatttatgaataatagtcatactttcctaagtgagaaatatattaaagaatagcacttaaaattgttgctagtctttttatatttggcttagtaaaagatggctagattctcatatctgtttgtgtttatagtcggttgcagtgtatcagaagtcatgcatcttctagaaaactctactgtatatttgagagaatgaaaaaaatgtttttagtgttactataaaaatagggttgacctcatggacatctggaacagtatctctgaaacgctttgagaaccactgtgctgtggtactatttttagttcctttttttctttttaccactctgattcctttttcaaaggcaggatattataggacaggtgggagaagtcccagtgacatatcagatattcctaaatgttgagcttttagcacttaaatgagctctgtgattagggtttgtgagagagcacattgaatatccactgtagtcctggttttaaaatttacaaagggtcctcctttgccccccagtcatacatttaaaaaggaatggacacctgagggcagcatgacataatcaaacttatttgatagcaaagcatgcaaaataaaagcaaaacaggagctttcagcagagccacataactgaagtaattaccaaatcagtagtatgcctttccaccatttattgtaacatgttggaggaggtggaattgtcatatgggagagtatgcctgctgtgtttttaatatcctgagatttatgaagccagattttaccaatggatgatgagggcttttagtttctccaaaagcacgttttccgcaaagcttccagacctgacactatcaaaaatgaagaattttagaatcattatgcttaattcttcaacctctgaatcagagtatatgctgttgtcagctttcctagtgaatacctgattgacacagctgccctattcgcagctctcctagggctgattttaagttaggcgatggtcagagctttgtaggttacattccccagattgccagggatggcacgctcaaagatttggtcacccgcttgctgagtttggtgccgaagcttgtatacggtttctggctgctcctgatatgaatgaaattctccatcttcattttcccctttgctctcgttattgcaacagaagttgggagctgcttctctgttatggtcaggggaaagtgccctttattttaacaaagcgaaaacctgcatttggagaatagaatacatcaggatgcctaacctgtttgcttgctcgctcacgatgttgtcctcagtaccaataccacttccttctggttttctttaagacaaggggtagacaagttatgactcataggcaaaatccatctggggcttgtttctgtaaatcagtgttatcgtaaatagccaaacccagttgtttacatcttcacaccaattatagtgttgaataactgtaacagaatatatgacttgcaaagcctaaaatatttactctctggtcctttacagaaatttacagaatttgtctgttttggagtcttgcccttagttcacgaaacctgctagagcttggacacttgtttccccaaattctttactaaaaattgtttatgggaatgtattaaacatattgaggataagttcttccagaaatgataaatttatcaaggaactttgctctaaagggcatttaatgtatctttaaacgaacacaaacagagaaaacatctttttatcataagaaagcatttgaaaatggtaatattgtcgctgcagagagtagccttaaattgttgcgggatgacgtaggcctccgatatagagagtattttgacttttgattaatatttgctcccataaaggatgataccttgattagccaaatatttaagaattgggcctgcctggaattttggggttccaaatagaatttttttttaaactttccactttgtcatctattttgttatttgatattttttaagtttgattaaaatgcctactgattttaaaggtaatgatccagagcttcatctttagttgcatctgttttgatagaaaatatattgatttcaaggtaccatttctgtacctctcaatgcatcaggaggcattttcaaatctccatgctttattgatttaatgggaagaaatttaaaatatgaaaaagtattattaaagtactttattggcatgcaactggtcaacatttgtttcagagcagaactacttttatgcaaagttatccaaaactaatttgggaagaaaatgaatggaactgtgatagtgtatgagcttctcttggatacttatgaagccttgagccacaaaatcactgattagaatttgctttattcgttgagtagtgtttgcctgaataatagtattttaaaataattgagacagcctggtacatgacaaggagaaaaaaatccagacatcgtgaggagtatttcttgatgacaaagacttcattttacttttattccctttggaaatggtataaacgcctgagtggaaggaatgtgtttaaatatgtgccagtaagcagcaaaatggactgatctgactcctcaccttttgttcctaataattcttgcctagaagaatgatcagtgagtcagaggagtacaatcaacagataaaagcaacttcagctagtcaagcattcgagaagttgttggacatttttaacacatagaaaaccacattatctttattctctgaaccagtaaagaaaattaaggtacagtctattggatgattgtactaatacttgcttactgcgtaggactccaagtatttgaattggcttttgttggtctgaatctatatatccatcttgcccacctaactgctatttttcctaatggctgtttcaaagtccacgtgagtcaaattggtatctttgtgctgacatagataatggtatggtcactgttgaaattggacagaaggcactgccaaataagcagttaaagtaaatctgaatttaggatgaggtatgatttcatagaccaaaatagcttcatagactttactgttttaaaatgttatgaattatgacaattattacttaaatgatgtttttaataattccttaaagtagaaattaatggtgtcctgaaaaaacacttttgactctgtagcctttaaatatcttgttcatgaatctcccaaaagaattttttttaaatagtatctcttcttcaagtttaaattggaaaactttttgtttgaaacggagtctcgctgtgtcacccaggctggagtgcagtggcgcaatctcgactcactgcaagctccacctcccgggttcacgtcattctcctgcctcagcctcccgagcagctgggaccacagggaaactttttattgtaagtttaagtataggcgtatctcattttattgtcctttgctttattacactttgcagtcactgaacatttttcctaacaaagtgaaggttgatggaaccctgcgtcaagcgagtcttatcagtgccatttttcaatgaaccattcccatataagacagcagacttaattgataaatatatatgttttgactgcgccaaaggctggccattcccccatctctgtctcctcaggcctccctattccctgagacacaacagtattgaaattaggccaattaatagccttagaatggcctctaagtgttcaagtgaaaggaagagtttcatacgtctcgctttgaatcaaaacctagaaatgattaagtttagtgaggctgagataggccagaagctaggcctcttgcaccagacagttaataaagttgtaatgtaaaggaaaagttcttgaaggaaattaaaagtgccattccggtgatcacaagaataagaaagcaaaacagccttattactgatacagagcaagttttggtggtgtagatagggtatccaaccagccacagtattcccttacaccaaaacctaatccagagcaaggccctgagtctcttcaattctatgaaggtcgagagaggtgaggaagctgcagaagaaaagttggaagctaggagaacttggttcatgaagttttaggaaagaaagtgtcttcataacctaaaatgcttggtggagcagcaagtgctaatgtagaatctgaggcaagctatccagaaggtctaggtaagatattttttcctagaaacaaggaagaacattttataataagggtcatttcatcaaggtgataaaacacttccaatcaatataagccccagtgatactatgacaaataagaaatacagatttggtctctgctcctggttcttgaaatggacctcctgagtgacagcagttctgacacagggttcctagatgccttggatgaatgataggagcattgtttattctaatgaggcaagccttggtgagctcctagataagctcagcaaggggacaggttgttaggggaaataaccatgtgattagagggttggaattttcagcctcccctccttccgcacacaccccacctccagggagcaagaatagggtgaaggtttagttaataccactgaccattgatttaatcagccatgtctgtgttataaagcctctgtaaaaacccaaagtatggggtttggagagctttgaggttggcaagtacatctatgtgcttggaaggtgggcatcccaacatcacagggacagaagccccaacacttaggaccttttcagacctcactctgtgtatctctttatctcactgtttatctatatcctttgcaatatctttgatattaaagggataaatgtttccctgagttctgtgagccctcctagtaaattaaacccagatagatgatcctgcaaacccccatttatagctgattggtcagaagtataactgacaacccactgctaccaattgacacccgaaacttggggtgatcttgtagggctgagcccttaacctgtatgagctcatgaaatcagcagatacatagtattataattgaattataaaacacccaactggtgtctcctggagaattggttgtgaatgtggagaaacccccacatacttcagtgactattgtgttgagtggtgtatgagtgtagggaaaaagtcttattccttctgaacacataataagccgtgaaagaacaatggacagaattggagggagaaattgttttattgagaaattagcaccgtatattaaataatgcttagaatcaccacgcacgatatcaacaaggaaatagacttgaacaacataaaaaccaactagatctaacagatacctgatgacaggagagtaatctttaaagtgtacatgaaaaatgctcaaggataggacaaaattcgcaaaaagggattgaaaacatacaaaacatgtttctggacataatagaatgatattagaaatcaattaaaggacatttatgtagtcatacaatatactcctaaataaccaataggtccaaaaaaaatttacaagaggaactaaaagatagtgatgaaaataaaaatatgttggccggttgcagtggctcatgccagcagtctgggaggccgaggcaggcaaatcactttgaggtcaggagttcgagaccagcctggccaacatggtgaaatgccatctctacttcagaatacaaaaaatttgccaggcatggtggcatgcacctatcatcccagttactcgagtggctgatgtgagagaatcacttgacccaggagacggaggttgcagtgagctgagattgtgccactgcactccagcctgggcaacagagcaagactacgtctcaacaacaacaaaaaaagcaaaatgaaaatacaacataaaaaacttatggtatacagctgatgaattgccaaattgcaaattattgctctaaattgctgtattttagaaaaatgtcaaatttacagtctaacctaatgaaagaaacaaaagcaaactcagtccaaagaagggaaagaataatcagagcaaagatgaattaaacagagaatagaagagtaatagagaaaaagcaatgaaatcagaagcttgttttttgaaaagatcaacaactgacaaaagttgaattagactgaccatgagtaaaagaactctcaaattactaaaatcagtaatgaagagggcattactattggccttatggaagtaactactgtaagtgaatattgtcaacagctagataacctagatgaaatgaacaaattcttagaaagataaaaactactgaaactcaaaaggaaacaaaacctgaatagatccttagcaagtgaagagtttagtaatcagaaaacttcctacaaagaaaagcctaagatcaaatggctttacttgtgaattgcatcgacatttaaagaagttttaacatcagtttttttacacccttcagaaaaaaagagtaacactttttaagtaattctatgagagcactattaccctgataccaaaatgagacaagtcatgataaagatatcccttatgaatatttcttgcattctaaaacaaacctaattcaacaaaatataaaaaggattatatagcatgaccaagtgagactgccactgccctgcctacggccatgtgccacccagctgcgtgccacttggatgctcggtgatggccactaggccctttgtacccctaactgctggcacccaaagctgtagcttggggccccaagttagccctctgctgctgttgcagccgcagacattatgcataccatctaagggcctgaggacccattcactcagcccattgttgccactgctagcacacagacaatccacttgaagaccaaggattcgtcctcctgacctgcttttaccaatatccacgtgtgttgaccgagatcctgcatatccatcccagagttgccatcactgttgcctaagaactggcctgcctgatgtccctttcactagcaaagcctcactacagccgttactaaaagccacagctttatccactgaggaactcatagacaccactgatgctaaagatagtcaaagaagtcatatggagactgcactgcttctcccacccagaatcaaagccaaaacgccttacccaaacaactctatagatagctctatagaaaaaaatgtctttcccttcgaaacccaatccatagagttggatgaagcaaatgttacaccagatgcatagatataaatgtaaggacacaagaaacatgagaaatcaaggaagcatgaaaccatcaaaggaacacaataattctccagcaacagatgccaatattaaaaaaaatctatgaaatacctgaaaatgaattcaaaatatttctgaaaacccaggtactacagaaaacagatgaacaatgcaaagaaacatttcaccatctgtatgagaaattcaacaaagatgtcagaaagaagttaaatagaaatcctgaaactgaagaattcaaagagtaaaataaaaaatataatcatcagtttcaataacagactctagatcaagcagaagaatttgtaaacttgaagacaggtcttttgaaataacctgagcagataacatttttaaaaaaaataaaaacgaagaaagcttatgtaacacatacaatgacgaaatagtggaattttcagttttcctggaagagaacagatgggtaatggcatagaaaacccatttaacgaaataataggtaaaaacttctcaagtcttggaagagatacagacatctagatataggaagctcgaagatcttcaaatatattctaccctgaaaggccttctccatgccacttcatagtcgaactgttaaaagtccaagaaaaagagaattctaaatacagcaaaggggtcaagtcacagagaagagtatccctatcacactaatagcaaatttcttagcagaaaccttccaggccatgttccacggtggaaaagtctatacaaccctacccccaaagttcaaggaatatgagaggccaaagaaagaggctgacaaattcagtttcttagaaacatttaatagggacttaggaacatttaatagggattgtgtcttgggaggtacttcaagagacaaagatggtggatccctgtgcctttactcccaagacctagggcttatatgccatagaaaaaggatatgcatgcatcagaagggctgtgtaggataactgcttaagggcattgattatagcaagtacaataacatttacattgttttgacctaggaatgggatttatggtaagtacatgctcttaagtaaaaataaactggaaatcttagaggccttcttggaactggggttaataagaaatcaacgtggtggatggaattactttggccactgcagtccaggagtaaatgaaatgataactccaaagtggtgaaaagcagaacaaacaaaaaaacacaactgtcagccaaaaatattatacctggggaagatataaaaaatgaaggagaataaatgctttccaaagcaaggaaaaattgaagttaatcaccactctactggccctacaagaagaggtcaagggagccctgcatttagaagataaaggacaatatctgtcataatcaaaacacataaaagtataaaactctgggccaggcgcggtggctcacgcctgtaataccagcactttgggaggccaaggcaggcggatcatgaggtcaggagattgagaccatcctggctaacacagtgaaaccccgtctctactaaaaatacaaaaaaattagccaggcttggtggcaggcacctgtagtcccagctactcaggaggctgaggtaggagaatggcgtgaacccaagacgcagagcttacagtgagccaaggtcgcaccactgcacactccagcctgggcaacagagtgagtgtcggtctcacaaaaaaataaataaataaatagaggaggcaagtgttactactacagaaaaccagcaaaccacaatgataagaggagaacaggatgagaggatacacaaaaccaaaaaataattcacaaaatgacaggaattaagtactgaataataaccttgaatgtaaacagtttaaattccccccttaaaaaatatagattggctgaatagaaaaacaaaaaaaaaatgacttaactatatactgcctataaaaaactgactttactggtaaagacacgtagactcaaagtgaagggatggaaaaagataatccatgcaaacagaaaccaaaagcaagcatgagtagctacactagtatcagataaaatagactttaagccaaaaagcggcaaagaaggtaattctataatggtagagggaccatttcagcaagaagattaaacaattctaaatatttgtgcgcccaacactggagcatgcagatatagaaagcaaacattattgaatctaaagggagagactgagtccaataaaatcagattaggtgtcttcaacaactgactctcagccttggactgatcatctagccaagtcatcaacaaagaggtattggatttaaacttcgttttagatcaaatgcgcttgatagacatttacagaacatattgtccaacagctacagaacaagtattcttatcacatgggacattcttgaggctagactatttgttatacaacaaaagtagtctcaacgattaaaaaaatagaaataatatcacgtatcttctcagaccacgatggaataaaactagaaatcaacaatgagaactttggaaattgtacaaatacaaggaaattaagccacaattatgagccatcactggatttaaggagaaataagaaacaaaaagtttcttgaaacaaatcaaaatgggaacacaacatatcaaaatatgtgggatacagcaaaagccatgataaaaggatgtttaatagcaacaaatacttacatgaagaaagtagaaagattttaaagaacctattgatgcacctcaaggaactagaaaagcaagaacaaaccagatacaaaattaacagcaggaaataataaagtcagagcagaactaaattagaggtgaaaaaaaggctatacagaggatcagtgaaatgaagagttgggttttttttttgagagaataaacaacattcataaattgctggatagactaaccaagattaaaaaagaagacacaaataaaatcccaaccaaaaaaggagacagtaaaacttatatcccacaaaaatagaagattgttagagactatcgtgaacaactgtctgaacaaattggaacctacgggaaacagattcattcctggacatgaggaaactaccaatatttggccatgaagaaatagaacacctgaacagatcaataatgagtaatgaaactgattcagtaataaaatgtcttctaacagagaaaagcttgagcccaggagatttttactgctgaatgctacaaacttacaaagaagatctaacatcagttctcctcaaactattccgaaaaattggagaggagggattttttcctagcttgttccatgaggccagaattaccttgatgccagaaccagataaggatacaataagaaaacactataggccagtattcctgacgaacttagatgcaaaattcctcagcaaaataccagcacaccaaatctaacaaatcaataaaaagatcattcacgatgatcaagtgggttttattccagggatggtaggatggtttattatatgtaaatcaataaacatgatacgtcacaaaaaggtcaaaaattatatttttaatataattatatatttttgcatctcaaatgcaaaaaaagggtttcataaaattcaacatcccttcataataaaaaaactcaataaattagacatagaaagaacacatcatagtaaacgccatgtatgacaaagctgcagctaactacatactgaggcagaactgaaatcctttcttctaagaactaaaacaagataaggatgctcaccttcaccactcatattcaatatagtactggaagtcctagccagagtaaccaggcaaaagaaatgcatccacgtttgaaaaggggaattcaaattgtcctttcttcagataacatgatcttatatatagaagaacctaaagactctacctgaaactcttagatctgatagatgaactcagtaaagtttcaaggtaaaaaatcagtgtacacaactcagcagtgtgtctattctctaataatgaactagttgaaaaagaaatcaggaaagtaatcccatttataacagctacaaaagaaaaaacctgggaataaatttaacccaggagtaatttcattcgatccagcaaccccactactatgtttttatccaaatggaaggaaattaatgtcagagttatagggcatccctgtacttactacagtactattcttgatagccaagatatggaattaatctgtgtccatcaacttatgaatacacaaagaaaatgtaacatatatacataatagaatattactcttccattaaaatgaaatcttggcatttacggtaacgtggataaaattacatttcattatattgagtgaagtaagtcaggcattgaaagacacatattgtatgctctccctcatgagggagtttaaaaagttgatatcatggacatagagagtaaaatgatatttaccagaggctgtggatagtggtggtggtgggattaaagggaggcgaatggaaacatatagttagaaggaataagtcctattctttcatagcaccggaggatgaatatagtttataattgttgaatatttcaaaatagctggaagatttgaaatgatcccaacacagagatgtagtaaatgtttgaagtgatgggtatccaaaatatcctgatttgattattacacattacatgcatatttcaaaatatcacatgtaccccataaatatgtatagttattatgtgttaatgttttcttaaacttagatttcagataaacaatctaatgaaacactgtaaagaactagaaaagcatgggaaaaaaactcaacattagtggaaggaaacaataaaggtcagagcataaaaagtgaagttcagattttaagaaacaatttaaaaggtcaacagaaatgaaaagttgggttttttaaaacattggcaaaattggcaaggcacagtggctcacacttgtaatcccagcactttgggaggccgaggtgggtggatcaggaggtcaggagatcgagaccatcctggccaacatggtgaaaccctgtctctactaaaaatagaaaaattagctgggcgtggtggtgcatgcctgtagtcccagctacacgggaggctgaggcacaagaattgcttgaacccaggaggcagaggtttcagtgagccaagatcgttccactgcactccagtctgggcaatagaggtagactccgtctcaaaaaaacaaaaggcaaaattgacaaactttttgctagtctaagaaaaaagaccaaaatcaataaaatcagaaacaaaaaaagagacataactactgataccgcagaaatacaaagaaacacaaaatcattagagactcttatgaagaagtattccccaactacttggaaaaacgagaagtggaggtatttttagaaacatacaaactaccaagaagattcaagaaccacgaagttcatcgggaactttgaagaaagaaaaaacttgaacagaccagtaatgagtaacgagatcaaagcactaataaaatggtctcccatcaaagggaagctcatgatctgacagtttcactgctcagttctgtcagacatttaaagaagaaccaggccagatgcggtgactcacacctgcaatcctagcacttgaggaggccaaagctagcagatcacgaggtcagaagttcgagaccagcctggccaatatggtgaaaccctgtctctactaaaaatagaaaaagtagccaggtgtggtggcctgtagtcccagcaactcgggaagctgaggcagacgaatcacttgaacctaggaggtataggttgcagtcagccgaggttgtgccactgcactccagcctgggcaagagatcgagactccgtctcaaaaacaaaaaaaaaaaattatatatatacatatatttagatatatatatttttatactatatatatttatatagtttatatatattttatactatatatatttatacattatatatatatttatacattatatatatatagagagagagagagagccatggtaaccaatatagtatggtactggcatggaaatagacacattggtcagtggaacagaatagagaaacctagaaatccatgcatttatagccaacttagttttgacaaaggctccaagaacatactttgaggaatggggagtttcttcaataaatggtgctcagaaaactggatatgcttatgaagaagaatcaaactagactcttaactttcacaatttacaaaaatcacctcaacttggattaaagagttaaatgtaagaactaaaaatatgaaactactagaagaaaagattggggaaacactacaatggtgggatgagtaaagattttgcagggggtcggcgggggaggggaagacctctaaattatgagcaacaaatgctaaaatatttagatgtggtgtcccatcaagctaaaacccttctgcccagtaaaggaaataatcaacaaagtgaagatacaagctacagaatggtagaagatatttttgagctatccatttgaaaagggattaataaccagaatatataagtaactcaacagcaaatggtcaaataactcgattttaaaatgggcaaaatttttgattgaataggtatttctcaaaagaagacatagaaatggccaacagatacatgaatagatgttcagtgttacagggaaatgcaaatcaaaaccacaggagatatcattttacccgagttaaaatggtttttatcaaaaagacaataaacaatgagtgctggccagaatgaaaagaaagggaaactcatacactctctgaaaaagacagtatgaaaaagagtgtgaatgctcattgaaaaactatagaactaccatatgactctccattcccactgcttggtatatatttaaaagaaacgaagtcagtatattcaagaaatgtctgcactcccatgtttattgtagtactattcacgttagccaagatatggaattcacctaaatgttaatttatagatgaatggatatagaaaatgtggtacataaatataagtggaatattactcggccatagaaaatgatgaaattatgttattggtagcaatgtggatggaacacagaggtcattatgttaagtgaagtaaactggcacagagcgacaaataccacatgttctttctcaaacttgggggggcttaaaaagtagatttcatgaaggtagagagtagattggtggttaccagaaggtaggaggaggaggggcacaggggatttagaaagggttttgaaaggttgattaatgggcacttttctctttccctcggggcatttggcagcggtggtggcttttgcagccgtagccaagattaaggctcaggatctttgaggcaagaaggaagaggagctgctaagacagctggacaacctgaaggtagacctgtcccagatgtatgtcgccgaagtgacaggtgcccgacattccagttctcttagattgtagtcatttccaaatctgttgcctgtgttctcaccgtcattagccaaactcagaaaacaaacctcaggaagttctacaagggcaagaaatactagcccccagatctgtggcccaagaatacttgtatcatgtgccactggctgaacaagcatagggagaacctgaagaccaagaagcagcagcagcaggaacaggctgtaccaacgacagaagtaagaggtctaggcatgaacattgctgagtcaaaattcaaactggaggaaaaaaaaaggtgttaggttaatgggcacaaaaatacagttagaaggaacacgatgtattgttcagtactgcagtagagtgactatagttaacaataatttgtatatcttaaaataactggtggagagcaattgaaatgttcccaacacaaagaaggggtgaatttttggggagatggatgtctcttttgccctgttctgatcattatacgatatatacatatatcaagatatcacatgtactctaaaaatatatgtagctattatgtttcagtttttaaaaactctgtttatatgtagcataataaaatattttgtgtctttaaaacaaaattaaaggaataactaaaggaatctgtatgggagaactgatcttgtgtgtagaggatcttcaggactatacaaaagaaaaaacctattaggactaaagacgttcagcaaggctgcaaaatacaagttgagcatttgcaaaacaattgcattgctatatactagcaatgaacattaaaagtgaaataattttacagtagcatcaaaaaatcaagatattagagaataaatttaacaaaataagttcaagtgaaactacaaaatactgaagaaaggaactgtaaaagtggaaagatcttttatagtcatgtattggaactttattgttaagactgaagtactctccaaactgatcttcagattccacagaatcactgtgaaaatccaagttcactttgtatatgtatgtaaagaaatggacagacaaatcctgaaatttatgtggaaatggaaagggcccagaatagtcaaaatatagaaaaagaggcaaaaaattggaggactcctgatttctccatttcaaaacttatcaaaccatgctgcagaataataagatgcaaataaaagggaaaatatttcatgttcatggactggaagacttaatttttttatatattatactatacaaagtaatctacagattcaacacgattactatcaaaatctcaataacatttatcccagagatggaaaatgttctaaaaatcatatgagagttcaaggtaccccaaataatcataacagttttgaaaaagaacagagttagagtactcgtatgttattttaaacatattacaaagctacagtagtcaaaatagtgtggaactggcataaggacaggctaatggaatagaatagagtgcacaaatcctcaaatcttcaacaagagtgctaagaccactcattggggaaatgtcagactttttaaaaaatggtagtgtgaatacagtatcttcatgcaaaaaaaagagaagtaggacccttatatcacacagtgtataaaaattatctcaatgttttaaagacctaaatgtaatcctgaaactataaaatcctgagaaaaaacataggggaaaaacatcacgttattgtatgtgccggcaatttcttcactgtgacaccaaaagcacaggcaacaaaaacaaaaatgggactacatcaaactgaaacgtttgtgccttaaaaacaaaggggtgtgtaaaggcaacctacagaatagaataaaatatttacaaatcatatacctataaggagttaatatcggactgtgtaaagaactcctatatttccacatctaaaaatcaaatatcctgattttaaaaggggaaaaatactttaatagatatttatccaaagatggtctagaaatgttcacaagggccgggcgcagtggctcatgcctgtaatcccagcactttggaaggccaaggtgggcagatcacctgaggtcaagggttcgagaccagcctgtgcaacatggtaaaaccccatctctactaaaaatacaaaaaattagccgggcatgatggtgggcacctgtaatcccagctacttgggaggccgagtcaggagaaacacttgaacttgggaggcggaggtcacagtgaccagagattgtgccactgcactccagcctgggccacgagagcaaaactccatttcaaaaaaagaataaaagaagtgttcacaagcatatgaaaacatactcaacattctctaatctagaaatgcaaataaaaactacagttgggtatcacctgatacccactacgatcattgctatcaaaaaaaatagaaactatttttggcaaggatgtagacaaattggaaacgtactgttgtaggaattgtaaaatggtgcaatcactgtggaaaatagcttggagggtccacaaaaaaatgagaaatataactatcatgtgatacaccaatctcatttctgcacgtatatatataaaaagtttaaagctggattttgaagagatacttgcccacccatgttcgtagccacacttttcacattaaccaagaagtagaagcagaccaaatgttcatccacagatttatgtataaataaaatgttgtctctacataaaatggaaaatcgttcagccttaaaaaggaaagaaatcctgtcacatgctacaacatggatgaaccttgaggacattatgctaagtgaaataagccagtcacaaaaagaaaaaatatgattccatttgtttgaggtaagtaaagttgttaaattcatataaacagaaagtagaacgttggttacaagtggctggcatgaaggggaaaagaggagctctttaatgggtatagagtttgagattagtgaggtgaaaaagttttggaattctgttccacaacagtgtgaatatactaatgtgaaacagtactgaactgaatgcttaaaactgttaacatggtaaactcagtgcaaagcttcagtaatcaagagttatgctgatataaagctcaacagctagatcattgcagtataatcaagtgtctaaaaataatcccatacatttatggtctgttgatttcaaaaagagtttcaaaacaatttggtgggggaaaagtagtctttccagtaaatgatgtcgtaacaactgaatatccacatgtaaaagaatgaagttgaatctctgctttctatcgtacaaaaatgaactcaaaatgggtcaaatatctaaatataagagctaatgctacaaaattttttggagtaaatctttgtgatgttggattaggcaatgatttcttagatataaaatacacaagtaagaaaataaaacacaggtaaactggatttcacctaattaaaaccttttgtgcttcaaagtgatagggacaagaggcagggaaattctgggcagaagaggatgggtccccagtgagggctgcaccctcaagctgaaaagcctgatgcggtggcccaaagtgagaacttacatccctgatttcctgttcaaatgttgccttttccaaaaccacccatggcctgctctgccccccattcctgtgcccataaaagccccagcctcagccagcagagagaggagaagcagctggacattggagactacagctggatgtcagagagaagtggcttgacttcagagggacagtctgacagcataacttctgagaagaatctggccagagacagccaaacttcagtggcatttaccttcccactctgtccccttttcagctccccttcctgctgagagccacttccatcggcaataaaatttcctgcatttaccatcctccaatttgtttgtgcaacctcttttctcctggatgctggtaaagagctcaggtgccccaagtgtggttgcaaaaggctgtcacactgaccctttgcccttgctggcagaaggcagccatctcacccaaaaaggcagaggatccactgagctgttaacacttaagccatatgcagacagccaagctaaaagagcacccaaacacttcctctgggacttcaggggtcactggcacccctccccagatgttgctgcgggaccagtacagagttcactcctgctggtgcccgaaggcatttgcccgagctgccgtacccactcacctgtttgctccctccagcaaggggtggaacacagcagatttgagtgagtggagttggctgactccagtgctcatatactcccatatctgcccatgaaggggtcagggaaatatcctgcttcaaaaggacatcatcaagaaagtgaaaggaaaaaaatgaaaagacccacagaatgggaaaagatatttttaaagtacatatgtgataagaaaattatatctagaatgtgtaaagaagtcttacaactgaataataaaaatataaatattccaataagaagggaaaataggattttaacaggcctttctctaaagaagacatgcaaatggataattagcacatgaaaaaaagctgagggtcattagtcattagggaaatgcaaatcaaaaccatagcatacccgttcatacccataacaatacctaaagtaaaagggacagatgttagtgtctgtgaggttggagggaaactggaaccctcattcgctgcttgtgggaatgtgaaatggtgcagccactttgaaaatgagtctggcagttccttaaatgaataaacaagattaccataggactcaataatcccactcctaaatatatgcccaggaggaatgaaaacatgtttacacagaaacttatacatgaatatttatagcagcattatttataatagccaaaaaaagaaaatagtctaaacattcatcaatttataaatgaagaaacacaattggtatatccatacaatggaatgttgtttagaaataaaaggacattaaatactgatttatgcaacaacatggatgaacttggaaaacatgttaagtaaaagaagctagtcataaaaggctacattttatatgattccatttatttcacatgtcctgaataggcaaatctgtataaagaaaatgcagatttgtgcttgccaggtggtccctagtgagggtggtggaagagatttggagaataactgctggtgggtatggagtttctttagggagtaaatgttctgaatgtagatagtggtggtgattgcacacctttattaaaaatcactgaattatatggttcgaaagaatatactgtgaattgtattttaataaagatgatacttttttaaagttatagtagttgatgctatcatcatgtaacaaaattaacacacttttttaagagaaaaattttcgtttttatactcatattttagtgtacttttacaaagaagtttattaataacaatttatttaaagcagataatgttacaagcagttgaattttgcagatcacatatcaaaaaatagttttggtgattaactgatgactaaattagaccttcctttattttcatttaaagcaaagaattaaacaccacctgacttggaaaaagatttgttacctagtcattatttattcatctccccagaacatatctaaaaaggtattgccaaggtatatcataatgactgttcattgtatgtgttatttttttaccttgagacaccttgtttgacctgatacagttggaaaggattgggaaaactgagttattgtcgtcttcagtatactgttgcaaaacaatatttttcattaaagttcctttctgtgctttaaactaattatcaacaaaatttttaaactgcagatttaatttatttaacttatgagaaatatctactaaataagttagctgacaaagccacttctgtcaaaccatttttttcagtgtttcatacaaactatgcattctttgctgatgaaagaggcaaggtttttaacaacaacaacaaaaatgtcagcactgtcattgtaactatttagacagcttgaatgggacgaattgttttattttgtgaaacaggagaagggtggctgggaaaggggaggtgggaagtgatgactcctatggcacacaggtgtatgttctcaggcaaatctgtctttgaatttgaggttgtgtatacatattcccttaaaatgatgcctgtgcgtcttcttgaaagtcttcctctgttacccgagctggaatgcagtggcacaattatggctcactgtaacctcaacatcctgggctcaagcgatcttgcccctcagcctccagagtagctgggactgcaaagcacgtgccttcatacccagctaattttcatattgtttctagagagggatgttacccaggctagtcttgatctcccaggctcaagtgatcctccttcctgggcctcccaggcagtgtgggattataggcatgagccaccatgcctggcctcctttatatttatttttaattatttatttattttttgaactggactctctctctgtcgctcaggctggagtgcagtggcacaatcttggcttactgtaacctccacctcccgggttcaagtgattcttctgcctcagccccctgagtagctgggattacaggcgcccgccatgacatccggctatttttttttttttttttttttgtattttcagtagagacaggattctattatgttggccaggctggtctcaatctcctgacctcaagtgatccgcctgtctcggcctcccaaagtgctgggattataggtgtgagccaccgcgcccggcctctgctactttttaaaagtctatctccagaagtctgctttctcattttgaataccgtaggtattcaaatgaattcactttcaaatgaattcactaggtgctgttctacccttctgttagccttttacgaaagaatagcgtgaccttgaaaagcatacatttatgcatagtagtagtgtatgcaggtatatttatttatttggttggttggtttttttattttttatttatttatctgttttgagacggagtcttgctcttgtttcccaggctggagtgcagtggcacgatctctgctcactgcatcctccacctcccgggttcaagcagttattctgcctcagcctcccaagtagctggagttacaggcggccgccactgcacccggctaatttatgtatttttcagtagagacggggtttcaccatgttgagcaggctggtctagaactcctgacctcgttatctacctgcctcggcctccgaaagtgctgggattacaggcttgagccaccgtgcccggtcacaggtatattacgatgttggtacactttgtattcacttggactacattttgctagagatgatacctgtgacacttctctgtgctctgcgttcctctcctgcactcgtaacagatgtatcttgctgtctatacggaacctaaaaatcctccacagctagcagcttctactagttgtttggaactagaataagaggtgattctctgtgataacaattttgttagttttcttagtttgtttatatctttgctctttttgtagtttggattttctaattactttattaatgcaatttccttttgttaaactttattgtccttaaaccagcttggagacgtgctgggagataattttccatgggtctcacactttcctgtacgttttgcgaacagaggctgtgactgcctttgttcttttctgtcttttcaagattatttctatatacagtgagtagctttggaagatgctgtagtgacttcacagcagcggtcaggtttgcatatctccctggaaggtagagctggtatctcccgctagtgcaaagggataggcgtatttcccatgattaaagattccagctcctgaaggttagggtttctctcctataatgcaacacactgcatgtgcaggtggcctgtggccctattcaggttgctctgtgacatttgggacttggggaactagagcccagtggtcacaagataatgttgatattctggctgcccctgttagtgtaagtaataaataccttgtctctcacccaggagacttctttcctctgccagcattttattagcttgtgacaggctaacttgttagtttgaaagtagtgtaaatctcagatccttcacaggtcttgatagtatgtaggtaacacaaataaatgcataaacagctgagttcagctcagaaatgtccgtttttacccatgtttttcattaaaaactgtattatatattgtataaatgtagcgtcggtttttcaagtttttttctacattataataagtttttggtataagtttgctatttatatttaatgagaattttaaaagcataataaaccatgtttttagtgcagtaaaattgtatgtatgtgtatataaacctgtggttgctttgtttttgttttttgagatacagttgcactctgtcacccaggctggagtgtagtagtgcagtctcgactcactgcaacctctgcctcctgggttcaagtgattctcatgcctcaacctcccgagtagctaggactacaggcgcctgccaccacgcctggctaaattttgtatttttagtagagacagcattttgccatgttggccaggctggtctcaaactcttgacctcaagtaatccacgcacctcagcctcccaaagtgctgggattacagacatgagtcaggagccactgtgcccagccctgtatttgtaaatagatgtctagttatgttatttgtttgtttgtttgtctgttttttgtttttggtttttttttttgagatggagtctcgctctgtcacccacgctggagtgcagtggcaccatctccgctcgctgcaacctctgcctcccgggttcaagcgattctcctgcctcagcctcccgagtagctgagactacaggtgcatgccaccatgccaaactaattctttgtatttttagtagagacggggtttttactaaacatgttagtagtggacgggctttctgctaaacatagcccggttagccaggatggtctctatctcctgacctcgtgatccacccacctcggcctcccaaagtgtggaagttacaggcgtgagccaccgcacctggcctagttatgtttttagaaacaaattattggtctgcctcatcatatatttatgaatcagtcttaattccatgaatgtcatagtgatgtactgtttgcctctgtttcagaatattggaaagaagatgacctgtcaggagttcattgcaaatctgcaaggggtaaatgagggtgttgatttctccaaggatctgctgaaagtaagcatggaactattggtttttagtgtatgcttgtatttctgtttgctgcttacagcttaatcctaagtaggctaaggatcacttaagtattttgctttttgcttttggttttattggtgatgtttcttttaagccttgtccttgatttttcgtgctgcaaagtaccttaagttgataatttctagaagtctgcattataatcaataatactgaggtaagtaaatttggaatggttggtgatacaaatagtgagtggcagtttttgttcgatttatttgtaaatagactatcagaatttaagaaagatcccaaaggtatatgcactacggaaacagagtagcatttgcaggctataatggaaacagttccaactgtgttcaatccctagtctcagagccactcatgttgtctctggaaatagattaaattaaattctcagtaattgtagaatgcctgaattatttgcatttggctttattattggtaacatcagcatgatgtttttccccctcatcagattgttttcaaggagacaacaaaatcaactttggaattcatgcattctccagcattgtaaatgagatgggcatttgattgagtacaaaataatgataatatgagtatttggggggttgtagggtaagattgtatacattgagaatgtggtttttacagttgtctttttgattctagccttttaaaaaacagtacacgtataggtttcttttggaatcaatttctttaaatgaattttcaagaaaggtgacatttgaatcagctatggtatggaaatgtatgatatgatatggaaatgttgaaagagaagtcctttgttgtgttttatgtaacctttaagctacatagaatagagttctgccagatttggaaagacttatctactatggtaaatgaaagaaggcattacgatgtggtattacgacattcttagtcttactaactttatttgcagcacattacaagaaattatgaaaaaaaaatcaggaagaaaagtagctttaatttatggagtaaagaaggcattttctttaggtcctttgtacagcaagtgctgccatttctaaaggtataaatccaaatgggagcgggagataaatggtgcaggattgtgacgtgataaagatgttttacatcttccattgaatccgtatggtgttaacaagacttttttcagtctagtgatatttgcatggaaaattatggagtctctctaagagaggatttgtgaggcttttatcaacttatgtcagaaatgaaagttgacaggaaaattttcatagtgaagcttttagaatttagtggtaggcttatggtaacctgcatgacggttggcaaattattggctaatttagagcatgtttggcggagctgtatgaaaccgtgtatggttaatatacagtccagaggctactgttcaccttgagtaaacgtgttctttgacttcctctaccaagaatttgccagatgatttgttgctgttgtgcaatgagattatgtttataaacctcatgggaaagtatgtattatttgtttttttgttgtgagaagatgatagtgaaatgataccgaaaatggtggtggttagcatggtaattgtcaagtgaagtattgattctcttccataacaaaccccagccgctcacccacccaagatagttttccatttcagtaggaatgggttttactgaaaatttcagtaagaaaaggttttctttaaaccacgttggtttcattcctctattctgtgtgctgttcggttttccttccctttcctccctttcttcctgccttccttttctcctggtttctttttatttctgtcttttactttctctttggctttctatttttcttttggtgtctttttttctcattctctttctcttagaatagctgtcgctggattccctgctgagataaattattgggtggagtatatacttgaattctgggggaaaatattgttacatatgtgctacacagatacatacatacatagaaacttttcaaaatttggtgtcatcttacaggtttttaatatcatggtcattctctctttctttgccacctttccaatctccatgttacaggcatgtgtgacattaagttttttttgtgtgaaataaaaggaaaaattatgacctttattaggtttcctcataatcatatatagaaactgctagattcaatattaaaaaagcttaaagttacataaactgaggcttttattgttacgtattgaccttgatacttttagattaatttggttcaaaagtaacatttggatttatgtctgttcagatttctttggcccagaagtaacatttgtacttgaatgtctgttgttccatgtcattttgtagctggaaacatttattaaaggtctgctgtgtgtttactaggtgttgtgggattggagaagatgctgaaaccaaatgggcacctgtcctcagagatcacagactactgagaaatattggaggtgtctttctccataaaataaacagttattccatgttgaaataaaagtataagccaaattctgtttttttgttgttgtagttgttttctgaagagaaagggttaagaaaaaatagaccttgacatatttaaatgtgtgagaaatgagaagcttgtgtacagtccttcaattcagttgatttaattaatattttgcttctgaatttgccttatactgtattgaagggatagatgatacattgagccctttttttagtttaaaattccattgcagctttcgttgtttactcaaataacctaaaccgatatttgacattttttcccctacagggtgtttacagtgtaagatatggatatgtgtaataaaagtgaaataagttggatatcagaagacaaccagtgatagcatattacttaggttcttcaaagcagaaggctgggaggaggtgatgtttgagatggtgtattagtccattctcccactgctgcaaacaaatacctgatactgagtaattcataaagaacagaggtttattttgatcatggttctgcgggctgtacagaaagcctgatgctggcatctgcttggcttctagggaggcctcaggaaacctaaaatcgtggcagaaggggaggcaggcacatcttaagtggccggagcaggaggaagagaggaaggaaggagatgctgcacactgttaaataaccatagctcaggagagctcactcgtcatcatgagaacagcaccaaggggacagtgctaacccattcatgagagctccgccctcctgatccaatcacctcccaacagaccccacatccagtactacggattattattcaacatgagttttggtggggacacaaaccatgtcagatggccttttgaagtataggtaaaagacttgttatcttggttattattccattgcatttcctgccccttctttcacccaaagacattctcatatttacccctctcaactacatgaccaaatcaagacagtcattcatataacaaaataggccagatcatctggtatgattcacatagtacagataaacacagaaaaatttgctactgtcttacaagtttctgattaaccctgtgatcatgtttctactggctccacccatcccagcggttggatgtggtttgtattcaagcatccttggggacaatggaagagaaaggggaggttctgctttgggtctgatagattttgtaaaacattcgtaaggctctaataagtattacaggtactaacgacgtgaataaagagggataagaatgtagaatgcaggctagctctgtattgtaggctgtgttttgagagacagtacggtatgaggattgagattatgatttgagaactgtactgactgggttctaataccaggttctgtctcttaatagtcaggggactacgtcaagtaaatagtgtatttcaatatcctcatctataaaatgggagattttagagtcctcacatatagtaagtattgtctgttagctattaaaactttttatttttgatattattttacttagcctaaagtgggctggaaggaccctatcccttcctgcaggtatctggttttaagactttttagaggcgagtgagattagcggcagtagtcaaaacctctacccaccatccctttttagcttgctgctttccaaagatacatagcctctgctctttgaaaggaagcacctgtgacgttgactgaaaatgaatcttgcttaacccttacctttttaccttgttaacagcctctttctcctgggcctatccttcttcccacatttttaaacctgacgtttgatttgcgtttttagtgacttccctctttgatgctacaagaggggaagtactagggtgcattggctcttgaactggtcctggaatcttgaagaacctttgaggaagcaaactagttcatattctgctaagatcccaagattatcctggaatattgatggagatgtgaattacttgaagtgattaaaacatccctgggggagacaagggttgctagagatgtgccttcctaatggagaggcgttggtctgaaggatcaggtccaggaattgttgggattctgctttgtctcggggcaatttttatggactcttgactgtgtcagcctggggacttctttcacccagtcttatcagcggctgataccaactagtgaagtgttagcttttgattatgtgcatatttctgaaactcttcactctgtagaataacctttgaaaattcataacagcccagatacggaatcatcctaaatgttcatcagcagacgaatggataaaatgtggtagatatgcacagtggaatattatttggccttaaaaaggaggaattctgtcatttgtgacatcgataaatctggaggacgtttcactaaatgaaataagccaggcacagaaagacaaataccgcatgatctcacttacagtggaatctaaaaaagttgatctcacagattcatggagttaaatggtggttaccaggggtctggggatggtggggatttaaacaaagggtacaatttcctttcgactatataaataaatcatagagctttgttgtatagcatggtgactatagttaataacatcatattgtttgtttgaaaaatactaggagaatagattttgaatgttctcatcacaaaacagtatgtgaggtgagaaataggttaattagctttatttaatcattgtacagtatgtatgtgtactcaaaatactgcattgtgcaccacaaatatatacttttcatttgtcaattaaaacatttaaaaataagaattttcttgaaagttcctctatcttaatgttcaaaatgcagtgtcttgatcctctgcatttctgttccctgaattttatttctactgagtttcttaggaaacccttgttcttgtttgtaacagaaaagctgcgtttctatcttctatcgaatctgctctgcatttctaactctggtggttgataattgtccatttctcattatatacagaaaagacacagggcctttcagtgatggtcaccaggtatttatatatttagagatgaattgtccatttgaaaatgtatttacatgaaagaagggaagaaactgagaaataaatgacaagaagatcctggcaaatggtctaggaacataaagggtggaaggtcagttattggccgtcccataatttcattctgaagagacatctagactgtagattttgatatgacatgaacccaattgttttctatcccactttcccattgccatctaccatttaatactctgatactgctctccttagtatttttattccagtcattgttagatctttatttcttttttgagcagcagttaaattcagtaagtaccaagggagagtagaaagaaattagctgaaacagtctctcctttaaaaatttttataccaacttattgatggaaagaacagaaacaacaaaacaaaatgttccaaatatttgtgataaaactgaacacaatttgcagaatgtttaaaaacataccttgaatgtatttaaatacacaagtaggtctaagaataattctagttagaagacagtgtcactggaaatcatttaaaaacgtagggaaataaatcttacagataccaatcaatatgacagtcttttaggttattgcttgctattagatgtttgacattagaatattctttaaatttttaagtttttttatagaaattgctttacttgggaatttatgaactttgaaattagcacgtcttcccttaagggaagagcaaaagttttaatgtggaagaaagagagagagagagagagagagagtgtgtgtgtgtgtgaagaatgggttaaattgaaaggatgtaaatcagtatgcttggcctagcaggatttataagcttcactccatgaatggagtgataaaaaaacagtgaattaaattgttacatagtctgttggttagaattttaatgaaagttgtcattcaaatacatttgttttcccttgctttctcaaaggacagagtttaggcaagattctcttaggagacagttccaagaatatgtaggatacctccatcccgtttttaacctatcttgtcagctgaaaggattatatatgttgttttaaacataattttctcatttggttttcttaaggaaaaataatttgtgaaaatgatggagtaattagccaagaaggtagaatttaaacagactcaaaagatcagcaaagataaaacacattttaaataaagattaatgcatctttttggataaggaagaaacataattagaaaatataaagtgaggctctcagatttgtaaccattaggctttttaatcagttacagctgtatataagggtaaagaacaacagatgaatcagccattaaaaatctagagataagccatttttgtaagttcaaaccccaaaaaggatctgttcacacggagtgacagcaaaagctgtaatgattcttcttaaaaaaaaaaaaaaaaagagtaaaactgacccatctctctttctgagttccatctacccctttcagccagggagaagattggaaatttaacactgacaattgccctacttttcaatattttctaccagaaggcttaacctaagcaacatgaagtcttttttccctatttgatcttcccactctcattgttgctctctcctctctcatctttacttcctgattatcgctgagtacaagtatagctggagacatcagaataagactaggttttattaatgtcaacattctggtttgtgctatcatactatagttttgcagatgttaccattggaggatactgggtaaatggcacaaggactctgttcttttcttacaactgcctgtgaatttgtaattctgtcagtaaaacaatgacaaaaataatggacaagtccactctaaaaaaaaaaatggggcagtttgtctattcagccagaggttttaggcatcatataaaaataggcttaatgaaattttactactcttggtcattcttttaaagtactgagtacagtgtaatgaccaacagttcagaaataactatataacagtattaaaaacactgacgttttaagaaaaagacaatgggaattgttttgaagaattgaaaactggaaagtaacatgatcctatgtttattgtcatgttttactctggatatttgaagaattgtttaggaaagtggaagtggaaagatggtaaaatcgcaattgtctatgtgagaaggatggtggctcggatgctggtggtgacagtattgaaggaaatatattaagtattgaattatttagagcttcctattagagattctgctggtagactggtttcctcattgcccctttgtcccttacctgaacgaagtagaaaagaaacaaagagtagaatctgaattttctctacgcagttaatgtttgtttgtttgtttgtttgcaacggagtcttgccttgttgcccaggctggaatgcagtggcatgatctctgctcactgcaacctccgcctcctgggttcaagtgattctcctgacacagcctcccgagtagctgggattacaggcatccaccaccacgcccagctaattttttttttttttttgtatttttggtagagacagggttttaccatgttggcaaggctggtcttgaactcctgacctcaaatgatccacccacctcggcctcccaaagtgctgggattccaggcgtgagccaccgcgtccagatcccagttaatgtttatttggcctgttaggctgaatgtcatggaaggctgtgtggcagagtaaaatgagtagttacagatctggaaagtaatcccaatatcttaccttggccaagcaacttaatccttttcagttttctcaggtacggcatgggataaaaacaccttcctctaagagcggttaggagaattaaatatgatgaggtgtgttaagtggctagcagtgtgcccgtgtggaatgcactagttgttctgactgggttatggaagtcgctgggctctaagcctgtcttagtgttgctagtgactagtggtggcgcctccgggtgatcatttcactttgtgcctgagtttcctcatttgtaaaataagatatttggcctgtgcctatggttttcaggttttcggtttaggcttctggagcctgtgtccagtgttcactcctccctgtcaccgctccccttctgctccagaagttgttctctttttctgtcatgttctaacttcctctggtgatgtcttttgagcaaaatattatgtggcaaaaaagaaattggaacaacttcacagggtgatcttgtaaggatcgtttcagtctaagtgctgggcattttcttaacgtcattttgaatccaaatcgcatttctaaagtgttaactctcttagctctcaccttgtatttactggtttagacaaagaagtgtatacttaataatgaaaccagagaatgttcagatttaaatccaagaaaattgcttttgtcattgcagcattttcaaaagattattcccaaaggactacacaagaggaagaagcagacctcagtcagaaaaaggtctgaactttttataaaggaaaagcctgaactgaattctcaaaaatacttgatctgagttatattcggagtatgtagttgaaaataggaacttatgggtggtatttaagtgtagctaaaaaaagagcatcaactgttgcctagagtaggtgagttctttccaagagaaggtcatggaaacctggtagcaacagtatccatggaggaagagggcttggatgcctgtcctgtgtaagtcggagagccttttaagagaaaagctaggtttgcaagctttttaagagaaaagctttaaaggttctggcttaaaatatggaatattgctgcttttttcagtaaagtaaatcaagctgagttaggtgatgaaaggtgcgtggcgtgtttccgcttctgccctccccgtggaggtctggcagcctgctttcgctttcgatcacgtgctcatcatgggcagaataatgatgctgcttttggtgtggttcagaccatgaatgaaaaatggtgacgataatgagggtaatatttgaagtaactgaagatccacaaatcatgttcatgtgttttcttaaaaaaaaaaaaaaattaccaaaaagaagtctgttacaatgttttaacagaacagatgctgcttaagagtacaaacagatttttaacccccaaaaaaagaaaaaaggaaaaaagtttgagtggtggtggttgtaatcattaagggtactgtaatggaatattaatgattcccagtgggaatttatattgaaatttattttcaatttgatcatgaagaagtgctacagaatttcctattcagatgcatccatagacgtttgaatgtttgtatgtttggagcatttttatgttatgttatgttatgttatgttatgttatgttatgttatgttatgttatgttgagacagggtctcactctgttgcccaggcaggagtgcagtggtacaatctcggctcactgcaacctctacctcctaggttcaggcgattctcctgcttcagcctcccaagtagctgagattacaggcgcgtgccaccacgcctggctaatttttgtatttttagtagggacaggggtttcaccatgttgaccaggctggtctcgaactcctagcctcaagtgatccgcccaccatggcctcccaaagtactgggattacaggcttgagctgctgcacccggccttgtttggagcatgtttaaagtgtcataacagtccaagattgctgcccctctcactaacatgagcatgtattattgatatgaatgtaactggtcacatcatgaataaaagctatcctctttttgcttatgatatgtcaggagactgaggagctccttgggatgattgatgccctcctttcagcagaccagcaatgcaaggataagtggaactaccatggcaaatattctatcctgaacatggtatttacttagccaataaggatacagaaaaacaaattttattttaaaggcatttataattatatagtcaaaatatcccataaaggaaaacagtgtgttgttatagtaatgcttcacttagctaaaggtcaatctttttttaaaatgactaaaaaaagtgaaaacaagcaaaaaaataaaaataactctcaacagccagaataattacagagtccatgtattaataactgacctcacaaatttcacacaacctgtatttagatcctgtttttaataatacccacaattagttttcactttgaaatttttgacctgatcctccccctggcatatcataatcttgggcctgtagacacaggcaaataccagcatacaagttactgctgactatcaccgagccagctgttcgtgggcaagttaatagccaaatccaactgattttaataagatgaatttaatagaacacagacatttaggttattacataaatttttaagtggaaattattcatttattaattttgagatggagtctcaccctgtcgcccaggctggaatgcagtggcgtgatctcagctcaccgcaacctgtgcctcccaggttcaagtgattcccctgtcttagcctcccgagtagttgggattacaggcatccgccaccacgccctcctaatttttgtatttttagtagagacagggtttcaccatattggtcaggctgatccggaactcctgacctcaggtaatccacccacctcggcttcccaaagtggtgggattacaggcgtgagccaccgcacctggcctaaattgaaattattttaaagaaacaattgttttctcagtttggccatgaattagaagaatggagttcaaggaagtgatgttcctcagatagaggggcagtagcaagaagtgatttgctaatgaggtaaagagaaaatgttgcaaccttaaagggcactaggtctccaaatggtacatctggagttgttttgaagagaggcagtcaaatctgtgtcgtcagtagcctctcagaatggctgcattacagcactgcaaagtaatggatgtacttagtgagtcatcaaaaatgttacattttgtttacttggtttgattaaggagacagggagtgtgaaatagattggaaagattgccagtaaaactatcttataaagattttttggcatttaaagaaattaccttcaatcagaaaatgcgctaatgtaggataattcatttctctatctaaaaccattcttgaactctgttccctgtcaatgttggatttttactgttatttaaaacattttatttgcttgttttaattgttttaacatttactcttcccttaaactttccatagatagcagcatagtttttgtgctaaattgttgtttttgcagaaacgccagaagccacattatccagatcttgcaaggaagtattttctggataatgcaggtacatgaactttcctcttcacaacataccatcttgtcagagggagttcacacattcttttcttttgtgtggatttttttttttttggagttggagtctcgctctgtcccctaggctggagtacagtggcatgatctcggctcactgcaacttccacctcctgggttcgagtgattctcctgccttaacctcctgagtagctgggactaaggcgcacgctaccacacctgactaatttttgtatgtttagtagagatgggatttcaccatattggccaggctggtctcaagctcctgacctcgtgatccacctgcctcggcttcccagagtgctgggattacaggcgtgaaccaccatgctcatcatcaccccagactgttgagaaaaatcctgataccttcacactttttcccagaaaaaaatgaacttaccctgttcatttggaaaccactgccatttgtaaaagatcacagagggaagtgaattcctgctcctggagcaaatcatgtcacgatgaggttacctattctaaaagcaatcaaaagcaattattccttgagaatgcaagacaggtacattgttactctttttgcctcatttccatgctctttctttcactcccaaaaacagcaatgaaaggcaaatatgtatactcaaaatcgtatctcgaaaggttatttgcatttcaggttgtttgtcatacagtatagacttagacaaaaatatatatatattatatattatatcatatatgattatatatttgatatatatcaaatataatatattatatatattatatatattatatataatatatattatatgtattatatataatatataatatataatatatataattatatatataatatatataattatatataatatatataatatataattatatatattacatatattatatatattatatatattatatatataataatatatatatttgaaaagttagggattttgagaacttactgattagatggtggtattgcttatcacttgcatttgatctccttccttccagtattcttaaggacaagagaccctcctgttggccacagtatgcctcatacctagtgtaattcttagaacagatcagatactcaacaaatactcattaaagaaataatttcagttttccgtaaaacacagtgtcagtgattctgcatgtacaacttgatattgtatgtagaattgttaatgtgtgtaagtatatgcataattttttattttttgagagagaggagctatacctatgatcagatattcagatggttgctcactgcaacctccgcctcctgggttcaagtgattctcctgacacagcctcccgagtagctgggattacaggcatccaccaccacgcccagctaattttttttttttttttatgtatttttagtagagacagggttttaccatgttggcaaggctggtcttgaactcctgacctcaaatgatccacccacctcggcctcccaaagtgctgggattccaggcgtgagccaccgcgtccagatcccagttaatgtttatttggcctgttaggctgaatgtcatggaaggctgtgtggcagagtaaaatgagtagttacagatctggaaagtaatcccaatatcttaccttggccaagcaacttaatccttttcagttttctcaggtacggcatgggataaaaacaccttcctctaagagcggttaggagaattaaatatgatgaggtgtgttaagtggctagcagtgtgcccgtgtggaatgcactagttgttctgactgggttatggaagtcgctgggctctaagcctgccttagtgttgctagtgactagtggtggcgcctccgggtgatcatttcactttgtgcctgagtttcctcatttgtaaaataagatatttggcctgtgcctatggttttcaggttttcggtttaggcttctggagcctgtgtccagtgttcacccctccctgtcaccgctccccttctgctccagaagttgttctctttttctgtcatgttctaacttcctctggtgatgtcttttgagcaaaatattatgtggcaaaaaagaaactggaacaacttcacagggtgatcttgtaaggatcgtttcagtgaggggcttagcacccgggccagcggctgcggagggtgtactgggtcccccagcagtgccggcccaccagcgctgtgctcgatttctcgccgggccttagctgccttcccacagggcagggctcgggacctgcagcccgccatgcctgagccttccccgcctccgtgggttcctgtgcggccggagcctccccgaagagcaccgccccctgctgcacggcgcccaggtccatcaactgcccaagggctgaggagtgtgagcgcatcgcgcaggactggcaggcagctccacctgcagccccggtgcgggatccactgggtgaagccagctggtctcctgagtctggtggggaggtggagagtctttatgtctaactcagggattgtaaatacaccagtcggcactctgtatctagctcaaggtttgtaaatacaccaatcagcaccctgtgtctagctcagggtttgtgagtgcaccaatcgacactctgtgtctagctgctctggtggggccttggagaacctgtgtgtccatactctgtatctaactaatctgatggggacgtggagaacctttgtatctagctccgggattgtaaacgcaccactcagcgccctgtcaaaacaggccactcggctctaccaatcagcaggatgtgggtggggccagataagagaataaaagcaggctgccggagccagcagtggcaacccactcgggtccccttccacactgtggaaggtttgttctttcgctctttgcaataaatcttgctactgctcactctttgggtccacgctgcttttatgagttgtaacactcaccgcgaagatctgcagcttcactcctgagcccagcaagaccacgagcccaccgggaggaacgaacaactccagacgcgctaccttaagagctgtaacactcatcgcaaaggtctgcagcttcactcctgagccagcgagaccacgaacccaccagaaggaagaaacgccgaacacatctgaacatcagaaggaacaaactccagacgcgccaccttaagagctgtagcactcaccgcgagggtccgcggcttcattcttgaagtcagtgagaccaagaacccaccaattccggacacagttctaatgcccactgagacttgaactattaaataggatataatatgaaggagaatgtgttagttttatattgctgtcgttaacaaatcaccacaaacttagtggcttgaaacaacacagattgatcattatctcatcgttctgtgggttagaggtttgggtttgcttggctggtttttctacttctggtttttccatttccaaatcaagatttaggcaggactgtgtctatttctggaggctctgaaggtgaatctgcttcaagttcattaagcttgttggaaggattaagttctgtgtggtcataggactgcggtcccccttttcttgttggttgttgcccaggggtcctcctcagcttctagcggtcacctttagtcctttgcgtgtggtccgctacctccattttgaaagctagcagagatggcccaagttcttctcactctctggtactgtctgacctcctcatcctcttctttttgcctcgtctttgtctggtttccttttctggtgcatcttctgagtgcctgttctcccttcctctttgaaggtcttgtgtgattacactgggcccacccagataatccagaataatctccctctattaaggttagttgatgagtaaccttagttccatctgccgtgtgccttcttagcagtggctagatgaacatttgattaaatcatcaagggatgagactcttagggggccagcatctttaaaatcctgcataaatgcggaattacgtataaaatactgtgggatttcagaataaagagaaatgactttcaactgggcagcatctggaaaagcccctttgagatggtagcaccttgtcgtctattgaaacgtagttccgatgggtgctatagagctggagtagaagggactctggttgtggggtaacagcttagatgccagtgtggagacaggaaggatgataacgtgtggtccactaagagcagccatatcccttgaatgtactccatgtgttagttactatttacagagttattcaggctcctaacatcagatttttctagatcaaagtagaaataagaggaacgtcaagaagataatcaacacgtagcatgcagaatcattattttaaaaggactaagacagttgtgtggtgtgattgttgtaccaccttctctttggctgttagaaagaactgagtagcgttacacatgaaaatgtgaaatctgattttcttatttctaaacttttaaaagctccatatctactgatacaaaccagagaatgtggcctttgggaaaagtctcccactctccttttgtattgccccacagggcttacctctgtgaccattctgagtgggctttgtaccctactttaggtggatgataacttcagcacagtcccagcttgtgtggagagatgatgaggtcatgttggcaggtccttggtgtctctaaacattactgccgtattataactgattttctataacaattccacataaaggaaaaatcttttttttttttttttttttggagacggagtctcgctctgtcgcccaggctggagtgcagtggcgcgatctcagctcactgcaagctctgcatcccaggttcacgccattctcctgcctcagcctcctgagtagctgggactacaggcgcctgccaccaagcccggctaattttttgtatttttagtagagatggggtttcaccgtgttagccaggatagtctcgatctcctggcctcgtgatccgcccgccttggcctctcaaagtgctgggattacaggtgtgagccatcgcgcccagcctggaaaaatctttattagcgttactctctaccacttcccttccttttcacctaatttatttataagctttaaaaagagttgtatatacctttttattttgaaagcatgcatctatacaaaggagtcacagaatactttctgccaacctttgaaaaatacaaaggatgtaactgcccacagttgcttttcttcagccttttaaagtgtgtatacataagggctaaaataacaaaaccagtgcagccagctggtccttttttcacatgctgcatatgagaaataggattaaaaggggaagttatggtggcagaaagccaaggggtgttttatgagagatcagcaatttcacttgcctttggtgactcatattttgcccttaaagcttctagtacatacgaagacttccgtagtctttccaaacctttctccctctctcttgccagagtttgttttccttccttctcttcccaccttccaccgaaacctgaagtgctggtcctgatgattagaggcctgcaaaaggaaactcgtcttcttctgtgtctttttttttcttttttttttactcactttgataagaaaaatagccttttcttggagttgctctctgcatactgagcagacattggtacacatgtaattcatatagtagttaattggcactatttagcagctggaaaggaagcactaccttccttaccatgtggcagtctcattcttgtcactatccagccataatctctgctggtgttctgattaaagctttgtgctttcagattcagagacactgggaactgtttctggtttcctctttttccattcattttcccactttaatatgctaaggtatgttttctgataattcagaaagattgctgttgctttcacctgtagttttctcttcctgtttccacaatgcatctgactttgagaatacattactttgcccatctattatgtcagtcatgtccacttctggtttctttcctgtagggaaaattgattttttaaaaatgaaaccaaacctttagaaactctcttaggtaatttcttccagctctcatgttcctatattttccttgtttgtaatatctaattaaaagcttattataaggatccttccagtgtcgttaacttcaagtaaactgtgtctgtacacctgcaggtacccacatacatttttatgaaaaggccaagctccaatttgtggtacatttttaaatcgttagtattaagaattgaagatgtgggggcattatttacgtttgagaagcccttttcaatcttaaaatctatagggttctaagcttcacattatctcatatgaacaaaggtgacaccgccatttaaaaactgaggctatgcatacacaggtagagagagagagcaagcaggcacatggatgcaagcacaaacatgctgagaaaatatccatgcctaagggcatttctttcagtcctcactgaatgtgcccttctattcatttgctacattaaatcacaaccctggcatttaccctcttaggatacaaattaataattaagaccaaccagtccatgaaaactcaaagtggaaagtataaacagtaacaaatgaacctaattgtattacaaattaagtattttgtaatttacactaaagggaatggaaaaggaaagaacgaacataaataattttgaaaaacagttttttaactgtatgccgtgtggttgaagacaaaaagaacagtacacaaacactgtactccagttagtaaatttgtcttttacaggggtatgagctattaattctgaaactattactgatgcagaatttttcttcttggtcacttcgcaaggtggggacccctgaccagcaacaccccccctggacctcccttggccacgctggtgtgccccagcttacctgtgttagagcttgtacctttgtttggtgtttccgaactcttagactgcactgaagaagaatgaggacacgtggggcatggaagggtgaggaggatggagaagaatgttttcgagttatgaaaacggctttcagcaagggtcagcaggggagggagggggttcctctgtgtggctgggtctggggccctttatggactcagaatggggagtgcatgctgattggtttgtaagtatgcaaaaaagattaaagcaaaaacaccactcaaaggtgggcaggacagtgtagaaaaaccaattaggaaagggtaggaaaccaattaggaaagggtatatgtaaaatacgtgaagggtggggacccatcagaggaaagtatgccagacaggaagacactctcagtttggtccaaagatttaacttgtagctcagctttcaggctttaaactatctttggcctgaaggtaggattttgcaggggacctgcctctgtctgtctgtctaggcatttgtctgcctctatcattactttatctgtatactaggatatgcaaataaacaaacatactatagatgataagaggcagttttctctctatgggagaaagaaattatgaataaggaaccctgtggtattggattccagttgacgttattcatatgaacttgtaatttttaatgtatggattgatgcagaaacgtaggtgagtttgcatgatgggtatgtatatatgcatgtaaatatacgcctgcatatatttcttagctctgcctgccgagcggatctagaagcactgatatctcaatatcaatgagcagcgtagcttccagaccttggtttctaaatactgttcaccagtaaaatgaattaatgctctgtggagaattggttggttgtagtcctggggcagggaaaatataaaatgagcctagaacatcttgtggtgccagaaagtaagtgctcaaaagaagagggtggtgtgccagaaggccaacctagccaacctggaggagctcctaatggccaaagctggaacaatttgagcaacaaagtgatagtattagattatactcagagaagaaaatgaatatccgttgaatacattttaaaaattgtggagaagggacaggtttttattacagaaaaattttaacaattgtgaaaggaaaggaggaaatggcaaatatcgcagtaattattgttgttgatagagccattgaaggatactaaatttagtagatgaaagttagggaagaaacaggatatttgtgtagtctcaaagtatctctcccaggatatttattcattatgaggggaaaatactaactttacaatgtagacagtgaaagataccaccttaaccaagtgatcaagattaacatcaccagtggcaaggcatctcaacatcatgaagcctctgatgctctaaaggagaagataacatcacttaacatcacttctctttcccaaaatgcctaacttcattgtaaacatgagaaaacagcagccaaacccaaattgcaagatattctatataataactggcccatcttcttttgaagtgtcgaggtcataaaagacaagggaatactgaagaactgtcaccaaatggaggagactaagaagccatagtaactgaaggccttgtgggttctagagaggatcatggaataggacaagggcagtaatggggaaactggtgaaatttgaataaggtgtatagttcagttaatactataccaacattaacgttctggttttgataattgcactgatggttacgtaagatgttaacattaagggaagactgggtggaggatttacaggaactctgtaccatttgtacaacctttttgtaagtctaaaattatttcagaagaaaaaagaaagatgctgggtagttaaacgtacaaaggtatgtgtacaaggacattaaaagcagcattgtatacaatagcaaaaaattgagaataatacaaatctcgatcagtgaaggattacatcagttatactttattcatgtaattaatacagttgttaaaaagaccacgtagagttatgagtagtggtatggatggcaaagtgaagagaaggggttaagagtatagcttctttattcatgctgcctggattctctgatacttagcaccaattctgtgaccttggggaaattattcctctatcagcttcctcatctggaacttgggaaaagtaaatatacctacttatgaaccaggaatgaggtttaaatgtgaaaatccatgtaaagcctacaggatgatacttggcacataaaaaatacttcataaaatatgattacctaattattattttcaaggaattgatggtggggaacatcaatacaaaattaagtatggaatgataccatttatgttaaaattcatatgtgagaatctagaagatgaatgtgttaatagtggtgatgtcaggggagcagcatattagggaacttctgggtggtggtggtggtggtggtggtggtggtggtggtggtgagagacagagtttgcactttcacccaggctggagtgcaatatagcgatgcaaccatatctcactgcaaccacaaattcctgggctcaagggatcctcccaccttaacctcccccctcaaagtagctgggactgcaggcatgtgccaccaagcctagctaattttctttcttttttttttttttttaatagagacagggtctttctgtgttgcccagattggtctcaaattcctggcctcaagtaatcttccccctcggcctcccaaataggaacttccactttctaagttaaatattttaaaatttattttgcataaagtatactgaaggtatccagggaacttcactccaaaatatggctccctggtataataggtattttgaatgaaaggttcttagagatcagtaaatgtgggaagagacttttcccccatccaagtaaagactggacccaccaaggagaacgactgtttgtccttcacctccttgttatctcattatctattgtaacaaagaatactaaagaatgtaagcatgctcgaacattttctaaagaggaccatttacaagttcatctctgttttcccatccgttcattctccttggtaatcatttattgccctttgacagagttccctgcattcgctatctccccgctcctctatgaaaagaagctgtaggagtatgttggccccattggaatatttggggaatcactctgtgattgtcccttgtacatattaataaattgtatgcttttttcgctgttattctacctttggccagttgattttcagtgaaccttcaaagggcaaaggggaggtttgccctttgttcctgcaatacagttgaagaagtatgcatagcaacttttaagagaagcctgctatcaatatttattaagtaaaaccagccatgaaaactatttctaaagctaaaggcatcgcatagtgtccaaggtcatatgacttgtccctcacattggaaattgtaagagacctgactgtgctctcagccacttaaaactagttgatgtctacagttctctgaaatgtgggtcttaacttggaagattaactaattactctagtgtataatcctaggttgtgaaaggttatggataacctaggtaaggatgggtatgactagctctttgtctttatgaaaaataaaccaaatggcttctaaactgtagcattttgccagtaataaataattcctgacatttttattagagtgattaaaacctggagttgggcaccaaaatggtgatgtaatctccaggactgaagttaaaaataggatagatatcaattgctttttaatctttaggtggtgatgggccaactgagttacagggggatccggaattcactaataccttcacaaaagctatctatgattatatacactgtaggtaaaatatatatggaaataactacatgttttcaaagaatatgcttatatttatattttggatataacatcagtttgtttcacgattataaagattttttcttccttgcttggtttgatgcctgtgtcattctgaagttctttatagtgtttactagagaactcagcctgaccattctaatttaagtgtatacaggttacgtagcaaatttaaggcccgtctgtctttgtggttttggtgatactaggttggttgcttggttggttggtttgtttctttctcttttttcttttttggtaaatcatatataaagcaaagtataccaggtttcttaaagaggtatattgcaaggaaataggaagatgattctaagaaattagaacaaaaggtgaaactttcttctgttctcttggacttgtgattcctttttatatcttccctattatagtccttttaaatttgaatcaccaaagctttccaaggataaaatgaaaatgtcgaaagcattattttcctcatattactcctggtaatgtttttatacatttttcatcctggtttcttaaacactttcgtttaagtatacattactggttgaccagctatttttaaatcttttagatctcatttcagttgtacttttttttgtcagggctccacctgcttttttattctgtttgcaacagtcactatttcatttgttggtaaccatatggcatagccttttttttttttttttttttttttacaataaaattagatgcagtgtgttgaagcccatattgttgtatcacagtctctggagagcttaaagtaggtgggagagggcatcccaaaatgcagcatgccgctgataggacggataatcttagcacaggattggattttaaaatactgcatttcaaaggtgccgacatatgtagctagtgccagtacaagagtagagtctatagatgaatagcacagctgcagtgttggtggagttttccctcctatttcccaaatactttggtttcttaaattctaggattgtttttaaactcttcttcctgcacactgaaattctaagattttaatatgatataagctactcccatggaccactgttgtaaagttgagatcatcatggtaacaaactctagggaaagatcaatggactcttggagtcacatcatcttggttaaagttctgaccctgacacttactggcattgtgacattgggcaaattaaggaggctttcagagtccactttctctaaccataaaatggagatgacatcgcatcttgtgaacagttgttacaggaggaaatgagattacatgtgtcacatgcttcgctcgttctctggaccgtaactcgtacctgtaagtgtccttccttcctttctccccaccacttactctcatctccctcttactcagtgttgtgttttctaagatttaaaaaacagacaacagaaaacaatattttaatccctttttatgttaggatctgaaaatctttagatatttcctttctccctttcattccttcattcatttttggctttgcaccaggacttatttcttgagggtcagataagccctctgacctcagggaggcacccaggttaatccacactcagagaaaagccggaagtcactgggaaagtctagtggaagtgctgaacccggaagcagctggaaggtaggggaagtgaagtcagcctcacagagctgaggtttaagggacattaggaggactaggagacaaagtcgtgggacagagggaatcatttgttcatttgaatatgaggatgagtgagagagaggatttccatgtgacttttgggatttaagtacctggtagggtcatttcactgagataaggaatatgagcaggttattagaaatggaagtaatcttaaaagattttctagatagtctgatattcctaaatcattaggtaatgaaaccgaggggctgtcaaggttaagctcaaaaagcagttgagattcatccaaggtcactcagactctctctgccaataataagagggcaataatgtgactgctaaaagggcccttagagaacaggactgaaggtgtgatggattctacttgagaattttgcaaatgaaacccaacacagttttctctttgtagctagggaaggtcactgcaagctgtcagaattgaggagaagtgaagtggaacagaaagggtgcagttgaggtcagattccgaggagagagagagtaggttgccaaaatttagtgctcataaagcagtgtgggggcgatccaggctgagttaacacagcaggagctgtcactgtggaacccgtgtcagcgtccagttttgcgggccagtcggagatcagacctgggaacagaagacaggaaagcaacgccgtgctaggggaatgtggagtgggtccagagcagctccatggacagcagctcctgctcgtggaggctggctggcctccactctggttgataggaacatcttgcagttttgtccctgtgagcttgtccatgcacaagaaagttactacgcagtctgttatcccagatttgatattatattatttgtgagttcttgacatttcttttagaaataacttatgttctaaagatagctgataatgttactttcatctgatttctaatattctttacaaatattagaattagactgatgaagacagatactatagttgatcttagccagaaagccaggtcaatttcaaatgttctcactgcaaaaaagtatttgaggtaatgggcatgttaatttgtttgatttgattatttcacactgaattttcaaatcataatattactttgtatcctcaaatatatacaatgataagttgttgatttataattaaaaaatgtggtttatttttttgctactataaataggataaattagagccctgtgaccatgctagctaatagtggtactgtatttataaaatgaatgtgttatctttagctattagacacatgaaaaatggaaattagaaaatagatttcaaagtacatattaccttcttctttattttcaaccctataataaaacagatgttttagaacactttctggttctctatagagtccagacaaaggcactgtatttacatgtgttgttttccaggtttgcccggcctcttgtttctttaaatactcttggtatttcaacagcgagtttataactaataattaagtatgggaacacctattttttcccttaaatagcttactctttttcttccacaaagatctgtttattgcctacagttctatatttttgtgggggaatcatctgcttccttgttactgattataactgggaagcattttcaatttaaattaatttttggttggttaatattcttccttaaatatatttattactaaatattcatccatctgaagttttcctagttttccatatgtgccttccaaaatgatttttgaaccacaaacatgtttattaattaaatcactaggcgaaatccgcctttagtccaagttgttctgaacaatctgtgatacctaagagccgaaggttcttcttaaaaggaaaagaaatccttgtggtatttttttgtctttaaaatatattaaaaggtacatttcagaacaaaaaaaatgactagaatttttttctagaatattctttgaggtgaagggatttcttggtgttttttttgtttttgtttttttttttcggagcgggtgtggtatagcttacttcttagcaatccaagaatagcatttctggaaagtgatcagtcagttcaagctatagtctgcccttgaatgtgtatgctgtttatatctctgtcatggagttatcaggtggctagtacgagtctttattgctgagagtaagatgccagtttgattttcagcctacttgtgttaaggtttaacctgtgatggaattcacatttctgataatgattactgtattaaaaatttaacatgtgatgtgtatggtagatcccttttataatatggctgctgtgtggattctatttagcatgtggtagattctgtccacaggaaaagcaactattcacagtataaacatcataggccagccctgtcctccttgacaatgcagatgttatctcatcatagaacattgtaattcgaagtcacccttgagatgatcttgatgaaccttcccattttataaatgagaaaaggagtttcagagagatagtgagttgtttaaggccctaattagtgtgggtaaagacagaacagagagaaggacagctacttgtccttctcactgccatggttttcccacctgccaggaggcctctaatttgaaatgatatgcaaaattggtcaccagaaagtcctggtaacagtttgtgatgtagaggctgagctgtggaattaacattcagttctgggcttgctcttctttccctgtgaccccatgttagccattcggatttcctgatttccattcctttgcccttctcccaatttcacactgattaagacttttaaaatctagcaaagatagcttctagttggtgtcatctgcaagcagaaaataatttataagcagtttctcttgatcacaaattgagtagagggagcctctgcctcctgcctgtgtgataaggatctgtgcaagggcatacttgcaaaaacaataggaaatcaggctcaagtaggtcaaaatcaaagttagaagtaaaccccatgatgcaagactagttttgtgtatattttctactgaagttcagtgaaataatgtctttaaagttagaaagtgataatagaccagagaacagtctgtaccctggggaaaaaaaataaggtatatactttcccctccgaaactgatatttgcaagacttatttatagccttatgcatattataaagccatagaccttttgagtaatttattgaaaatagcatagaggccaagcgtagtgactcacacctgtaatcccagcactctgggaggccaagcgagcagattgcttgaggtcaagagtttgaaaccagcctggacaacatggcaacactccatctctacaaaaatatatttaaaaaagtaagtcccacctctcgggaggctgaggtgggaggatcgcttgagcccaggaagccaaggctgcatgagccatgagcatgcactgcattccatcctgggctacagagtaagaccccgtcacacgcacacacacacacaaataaacaaatagcacagcatagtacctgggttcaaattaaagttccattattttctaactgtgggccctatttttctcatttgtgaactaatgcagtgtttctcagctgtggctatatgttagaactacctgggacaattacaaagactaaagaaaacaaaccagcaaaatagtgcacagcctctatccccagaaagttctgattttaattgatctggaaagagaacagtattttttcagatgctccccaggtgattccaatggacaactaaaccacaaaagcagatgactttgaagtccttttcacattttaatattctacaattctgagatttttttatgtcatctagtccaggctcacactcagcataatcatctctctatatttgaaaagcagcattttgtttttaatgttagcattcatttggaaagaatgctcattgccatcagaaagctttgatttaaaagatttttctgatcatcagccaaatttacctttggaaaaacaaataataagtctaattactgatttaattgatgacgattctgatatttgaagattacttctatgattcagcaaagttacctcttcttaggtgaaacctttccaatttttttcatctcttgtttttgtgcaccattatttccgtatctcaacatgctattctgctctggggtaatctgcccttatctctataaaatatttccctggagttgaactacagccccattgatgatcaaaggagggaacttggggattttgggtgattattcccttctcaaactcttactgaatgtaggattaataaatagactctagttttagtaaacagtttagtaaatggtgtttactaacacatactcgtctataaatatgtatactaataaacacagttgatgataaaattcccagcatttaaaaattttcatggtgtgccaggcattattctagtgtttaaatatattaacacatttgattctttcagtaacccttgagggtaggtaccattattttactttttagatataaagaagaaacagactaaggagcagagtagttaagtgtcttgccttcaatttcacagtaagtggcagagctagagtgttgattggataatatagggcatcttattccagagtttgtaagtatggaagttggaggttatagaaattacgtgagatatataaggtttatgcttatacttaaataggtaaactgtagcataggagatgtgctcaagtttgttggaattctacgttgttttaagaaagttgaaatttgtcagaagctactttccataaaaacaatttatagttagattgttttttgtagttagatatatctagttagatttatagttagatccataaaaatcaattgtttttatttattctttgtatttttaatgaattctgcttgacaatctttgttcaatttgccaaataagtttcctaaaacttaattttactattcaggtgcgtgtttcttagttgacttaaacagaaaatttctggtgctgtgtcactgaaaaattatttgaagaactgttgttggtatccaataatcctttgttttcccatagtttcatcagcctcataaatttgtactgattctaactgcttatgatcattatttcttagtccttgtctgattcattctgaaaactgaagctttttatgtaaggcttacccacttgaggttgccagtaaaaaccatgctaccaggagatagaaatctgtcagagaaaaactgtgcttgtagaacctaccctccatttaactactacagccttaaatatgtttgtagggcgaataaagaatataaagtgtaaaggcagcaaagaaagcattcctatcccctgggaatcttatcctagggagtagtgtgtccacttgggtacgtttatcgtccattcgccattcagtgtattactctgattgtgagtatctcaatgaccattctgataattgaagattacttctatgattcaacatagttatctcttcttaggtgaagctttcccaatttttttcatctcttgtttttgggcaccattatttccgtatctcaacatgctcttctgccctggcggtaagtagtctcctcttatctctataaagtgttttcctggagttgaactacagccccactgatgatcagaggagagaacttagggatttttggtgattattcccttctcaaactcttactgaatgtaggattaatcaacagaccctagttttagtaaacagtttctgattctgtatgctaaggcatgagtggtcctcggcgtatgtgccaatattactctgaattattgctttcaaggggataaagggcacagtctttgatgtgaggacttgattttccctttaacagtagaattttaagttttcaactgagatgaggactgttcgtttttaattcagaaagcctttgtaatggtattgctgttctctggaagcttttgattttggcttgagaaaaaatgatttaacaccttacaaaacatcagaatgagaaactgtggtcttccttctttttgttgacttttatatttacagttacgggttcacaggcttaaagctggagagggtcttgaagatattctaacccagtcacctcatcgtttagaaaacagtagccaacactgtacattcattgcttttaggtctcctcatgacttgctaagttccataagggcggggactttatttgccgtgtttactgttagtgcctccaaatgaattcaggtttacaagcaaataaatgaaatggagaacctaggacttggaaagagaaaagacttacccaagatcatcttgccaggaggaacaaaatctgacctagaaccattgaaccatcatcttgtgacaacaaaatttgtgtcttttccatgatttaaaaaaagaaaaaggacttttacttgggagtcttaatctgtattaaagatcagaatcatacacagtttatatttattagatactgtttttcagacatatacatgaatttcattgaaaagttatagtacaactctttgaatgaaggtatttttaatccatatttttatagatgaagaaacttgggctttgaaacaaaaagtaattttccaaaggctatacatagaggcagaattcaagtctggtttctacctccaagtttagtgatattttctacttttgtcttttacatggataccaatgtttgtcaatattaagaattatctagacccataagtaacaatcactgaaattatttttctagcaccttatatgttatagactttaatacctgtggatatgttaaataagtgctgcctttgcctaggggtctgtatttaaaaggcagcaaaaaaaacccatagcttctcagttcctttcatctgtggttttggccttctgtgtggtctgatttgaagggcttttctgctctttttctttttttcattttcccataattggacttggatttcctccttttggtcctaaatgatttgcaggcttcaaagcctttctactacattgcagacactgccggtatgggatgttagttgaggattaacatctgtagctggaagaaagataattgccttttttttggtttctgttgaggagtggagggaggaatgatgataaaccaggacgtgagtggaagccattgtgacatggcacatttgtctacgttctgtgaaagtaaaaagcctctgatccagtgaaattcttgtccaggctcaactgggctacttgcatagggactcagaataatctcatcacatctccactttgctgggcaaacccatctgccagccactttttggcaaaggtcatgcatgagtaataccaccatttgctattctcaaagagtcaggatttcaagagggggatggcattctgcagcattgcagttttagtgcaggataaaggatgtcgtcacaggatctactatattaccccctccatttatcagtttcctttttcacctgtggctgttctagtctttcttctagaaagatatgctagaaacattgaacttatacaattatgaccctaaaaagtagaacctctcattttttaaaaaaagagattttccttttttccctaacaatttatatattgtttacctggtaccaaatccttgtagcatttctttttgtgtaaaacatacattgagccaaaagtcataagaaaaagcagtaagtggtggttctaggttctccttcatttgttctctttctgtatttttaaaggaccctaataagatgttgtaaccaacgctgctgtccgtgatgctatagtctgcattgcacgtttcattctcttctttcttttctctccttcgttggttgaagagtcaagggcagaagatggtggtgatagggagggggcgtgtgtaggcaaggtacttcgtcccggtcatcttatctttttcctaatttcattttatattatcgtggttcacaatagtggggcttgtggtagaatatctgtgaaaaaaaaataaaaaaaaaaggaagaaatgatcacttggagttctcccatccctgcacgaacatgttgttccattcatcaggagtgtagagtctatttcccctcccgccgaagcctgggctggtttgtgtgacagaatgtggcagaagtggtgctgttgtaacggcaggccttaagaggcctggcagtttcggagccaccatgtaaggaaggaagctcaagatatcctgctggagggagaagccatgtgtaggagcatcaaggtgctccagcttgcagctggcaccatgctcatacattggactggggcatcttggatcctccagccccaggtcagctcggccattagcacatggggttgagacatcctgttctcactgagttctgccccagactgcacttgtgcagaatctctagcaaatgaactgatgatgatttaaagcccctcgcttttggggtagcttgttacagagcaatagattactgagacaggatttgtagcttcctaatcttccttcttttctcatatctgtttacggtgtgtccagatagttctatgactccgtatgtccatctacaatcagtattttgttttagtacgagttcgttaggcattcttcagtcgctatttcttgctttgtagttagtgggtttttttttcgggggggaggagggttgtttttttaccagctttatatttgtcctcacttgaagcaggtgactctcctgaaatgctcctagggggacatttctctgaggggcacagtgataccattttcttctagttgtatatgagagacagaaaattacttgtctctctcaaaagaaaaacagtggaaaaaagatgacttattttccctaaagaatatttcctgctacccattaaaccatagtgacctctcagactcctcaaatagctgtgcatcctactcactgatgggcagaaaacaaagcagaaggatctagggtaaacatttttatttaaaagcaaagacccagacactccaaggagagtttgcaatgtgtattttctgttcaaatggcaagtgttcccaggaaaacctggaaggtagttacctagttttattttagattttctggaaggatctgaaaccctttttaaaagtacaacttttaatttcctgagtagaacacatgactgttctgagtcctggtttcagtttctataagcaatttcctttgagcacacaaggtagtatttttctcatttcgttgtcagttttttgtacttaaaagatttattgtttctcctgttgtctttctgcctagcaattcctttcctcaagctgtcctaaacagttgattaaaaaagaattactgagatcatgtttgatacagggcagtaaattttaagtatcaaatagataaaagaggaagggtatagagaatctaagttgcctttcttaattggcagaatcttccaatgtcactttcatgatttgtttgctgtttccatccttctggtctttattttttaacactgactccatgagtgcattagtccatagtcagaataaatgttttgctatgtgatgaagaaggttttttgttttttgtttttgagacagagtttcactcttgtcacccaggcaagagtgcagtggtgcaatctctgctcactgcaacctccgcttcccgggttcaagcgattctcctgcctcaggctcccgagtagctgggatttcagctgcccgcccccacgtccagctaatttttgtatttttattagagacagggttttaccatgttggccaggctggtgaagagtgtttattttgtgggggaggtaaaggggtgaattttctagagaggacagattggaatgacttttagaaagaaattatctttttaaagttttatttaaaaataaacattactttcgaccttagctaggtacatgtgattttttttttggtagccatcttgccaactctaaaatgttattatcggctatttatttgttcagtgttttcatatattttaagtacacacatcttgtctttcagttatatcttaaatttctgaaaaacagtgcccacagaatcttaaactctaagacaaggcttcccaaaggacatctggcaatgtttggagatctatttggttgttacagctgaggcaattagctgctactggtattttaagggatagaagccaaaaatatgtgtaaacagtgtatagcgtacagtatctggcacatagaaagtgatcaataaatactttttgagtggatggatgaaaggccagtgaatgtaacaatggatatagtgtatcttttctttatctttcctcagaggtactaagggtcaacttcgttaaagatcagattgctagttcaactataaggcatggtcatctcattaatatttatatataaagggtttttgtatttcctccacaatgacaagtcaaagctagataatgttttagttataacgtggggtgtatatgtttgtttatattggagaatacttaccgcttgtcagctggagaaggagacattttacatattagcagatgagatttggtagcagtgttgatgattgtgctgtggtaccttcatacctagaaggtcaggtcctcattttattgttgtgtgattgtggaataaatgcagattttttagagctgtcccacggaaacatttcatagtcaaaatatctcaaaagaagtggtgccttgggaaaaacacagcatattacttgtcattagaaagaggcaatacttgagcatatttcttatttttgaaagtcagtagctagtatcccgtatgatattcctgtttcaaaaatgaggaagctttttttgctttatgatgctttcttccttttccagtctttatggaatgtaggctttgctattctaattaaaatggaaataaatgaatgtgataaataagagtttttactgggtagaaatgtttagtgcattgtagcaacgttggtaagagaaattgaattagtaatttcctcagtggaaggtttagcatgaggatttatttccttctcctgtgtagtaggctcaagatagggatgtgaaggattttcctccagaatggcatttgtaatttctcacagtggcctcatttcattcatggcccagagagagtgcaagctatttagagaaagaagagtttttgaaggtaatacatgagacagatgttgggtatcttttcttgatatacaattactaaaaattatccagttaaaatctataccttacataggaacctgcactgtacccttttttgtcttaggagctttgacttttgtttattcgttttatggttgttgcatgctacttttatttaatgtggtggcatgttcttaggagaactgcataagtctagatacagccctcttcatcttgaaataattttgggtaagaaccttacacaaggtcccacatttgacttgaacttggtattgagtatggactaatgttagacactgctgtgggttaaaggagtcagttaatctgatgcaacagagaaattgaaatcagaaccacttagagctgtttccttagctcattgcttaagcttttacagaatgcataattatgaaaatttataggtttgtggattgtgggggacgtgtggttcagaaatctctactgactagttcagagtctcaaaggggaagaaaattgaaagggacataaggttcttatagttgatgaagtctctagcgttaaaaattgcttattagtctctgttagttgttaaattttacagctgttctttttctttgggtgggaaaggtgcaggaagaatcaaagttttcaaatcaacaggttttcttgtgaattccacattttttgaacagacattttgagatacagagaaagcctgaaaccagatctctgcttttcttaaaagaaatcttccagaataactgagaagcagaactgacatgtgaggcgtccaccctctctgtccccttccccttcccagcttccctttcatattcattttcatagcttttttttcaaaagttttatatttttcaaaattgacatataaaggttatatttgtcatgtacaacatgttttgaaatctgtatacattttggaatggctaaatcgagctaattaacttatgcatgacttcacataactcacatttttagctcacgcagcgtaactcaaggtgactgcttggcccttgaaagtctggtccttgcccaccccagcagctttggctctttgctgcccatgtactccagaaccactgaacttccttcaattcccaaacacttttcctaaacactctgtcttgcctctaagtctccatccatgctgtttcctctgcctgaaacactcctccctcctttttgtctgggtaactcatactcacccttcaagtcttccgttagctgtcccttcctctgagaagccttccctgtcatcaaagtctaagtgttctttctatgtgcacctgtggtagctggtttttaattgactttgttgaatgtttctatgagactataagtttggagaaggcataaaccatgtctgtgctgtgcagagtttggtggataggaggttctcaacttttcattgaattcttgcaatgagtatttcagtgctcaattgtacggtgcagaaattccatggaaaatcagagaagagagaaatcagtgaaggctgaagtgatgagtgaaagtgggacttgacctgaacctataatgataaactcctttgtgaagtttaacactctctcttctacttccctttctccgcttttttttttctgtttttcataaaatcattcattcattcagcaaatatttaagggtccagtcttcaggcattgatctaggtggtgaagatataacagtgaaaaatccctgccctcatggaatatgtgttctaatagactaaatggataaaaatgggttaaatataagtctagaaagtagcttagtagactagtagggcaatgaggaggccaactcgatgggtgggatatgttacaaacttggactttgaatggttttccttaagagcataattttacttgggagagtaggtgggtaatagggaagtataaataacttctgagcaaaagagacttttcgtctgtaactggtatgcagacactgaaagtaaaaagtccagcttagacaggactgccaaaatatgggtaatgatagccagcctggaatagtgtagtaggggagggttgtggcagagaggtaaagatgaataagaggggtgtgtgtgtgcgtgcgtgtgtgtgtgtgtgtgtgtgtgtgtgtgtgtttggatttttttttaatttagctattgattgattgatcgattgagatggaatcttgctctgttacccaggctgcagtgcagtggcacaatcgtggcttactgcagcctccacctcccaggctcaaggagttctccctgcctcagcttcccaagtagctgcgattacaggtgtccaccaccatgcctggctcatttttttttttttttttttttttttgagacacagtcttgcggtttcctgggctggagtgcagtagtgcgatctcggctcactgcaacctccgcctcccaggttcaatcgattctcctgcctcagcttctagagtagctgggattacaggtgcccaccaccatgcccaggtagttttttgtatttttagtagagatggggcttcaccatgttggccaagctggtcttgaatacctgtcctcatggttcacccacttcggcctcccaaagttctgggattacaggcgtgagccactgcgcctggcctgcctggacgatttttatatttttagtagagatggggttttgtcatgttgaccaggctggtctagaactcctgacttcaggtgatcctcctgcctctgcctcccaaagtgcaagtgctgggattacaggcatgagccaccgcacccagcctagcaatttattttctaaagaaaatttcctagatggtggactgtctggatagtggaaataaaggacagggatgagttaagactatctaaagttagagccccgaagcgtggttggaacattaagatagtagttttggtttagttggaatgaaggtattttgcataagctgaatctgagatttcattagacctaggttcattcagttgatacctattaagcatgttctaggggttataaagatgcaacagaacagacatcgagttcatgttctaatagactctgagatgagaagatagaattgtttggaaatctttcgccatgagcatgaattaaagtcatgggaatggatggagatttgggcctagttctaggtagcagataatcctgtagtttatttaaacctctatatttagggtttgatataataacgtaatgattataatcagctatacagcagttgatattaaaataaggatacaagagaatattggggaattacagtggatcttttaagcagctatgttccttttctgtatgtggaagacgataaaagacatttctttgtctttaaattctaagctgttatttcattaaagttcagtaacttaatgtctctggctgcttattacttggcaatatctcactagctcatcgatgtcagtgtaggctggtctacaataaatgcataaaagaaacagaggccagtgattcatatgatttttaaacagatttggcacaggagtgcctttctgggtttagggaagtggtggacaaggcaggagagaaccacattcatcttctcctcttgtgtttgtcttctgtctttcaataacgtccatgaactgtgaggttagtgtcttggctgagagataagtatggcttggcattgattcttctgttgttacctcaagctgttttctagtccccaagaacagcactctcagtgggtgtggaagtgggcgggacatgaagcaatggttttacattgcattgcctggctacagcttggcatttctttcctttttctttttctttgcgtcattgccattggtgccactaattttgcttcccctctcttttataacttgtttcttcgggagttgcctagagtctctgcattatatcttatttggtattgaggcagtgtgttcttggccaataacctaggagatgatatctgttcatcttacaggtttagtgctggaggaattcattaaaaataataataaaacaaaaaggaaaaataaaagttcctttcagtgggtcttcttcttcctgtccctggctgtcctttactttgggacatgtactgactccattttagatgtccccgtctctcaaaagaggggaaagtggaacatgaggtgggagggtgatagaaaagaatgccaagcccattgtccccagtggttccagaaatcaaaagctagcccgcttgaaggaagtataatggatttctcccctttaggacaaagtgggattggaatactttgtttttcatctttcttctgaccccaaccaaggaaatctataatattcagttctttgaagatctgatcctacttatattttctccttttgatatttctgtcccttgtctgtttgtagcccctcttccaaaagctgactgcaggaaaagagaaagattactattttctaagtttcctaaaaaataaaagagttcttggggggcttgcgtcgcgttagacctaaaggatggatagaatttgggtggattggagtagaggcttactccaggcatgggttacataggaaatatgatggggagccaatacgtagaacctgtttgctgcactgaaaactttaatggaagtttatttggtagaaaagaacaaggaaattagatttgctcaatgattcccaacatggtagaattctgttcactttgtcttttaaaatccttttacatgacttttctttttctttcttttctgagccactaattttgcctaagcccacctgcccattccacatctcccattgttcccatctagttgttacgattgttctttgaccacatatttctccttatatccagggacgcagactgttagttagttatatgttatttccttgctgcttttattcatgccttcatttatttttccatttattaataagcttatttgttcttgaatcatttgttaagcccatgtatctttctcaaatgaggaattacgtgcccacattaactctctacacttcccccgccaggtccccaccagcagaaagaattattttatttttatttttatttttatttattttttttagagacagggtctcactctgtcacccaggctggagtacaatggagtgatcatagctcactgcagcctcagactctgggctcaagtgatcctcctgcctcagcttcttctcaagtagctgggattacaggttcacaccaccacacagctcatgttttattttctgttgagatgggggtctcgctatgttgcccaggctggctttgaactcctggccacaagagatgctcctgccctgacctaccaaaatgctgggattacaagcatgagccaccacacctggcccaacagtaagaactctaaggagatttctggctttaatattactgctatttgttttgcccaatatgattttgcctcatttttcttcttccatttatagaccgctgtaatagccttggtgacaggcattacccctctactcgtcctgatgctgagatctctaatccacatgattcttccacccctacctgcttataaagaatccaaaccctaggctcatattttcatcttctttttagtattttcattcttcttatgtctattatcattaaccctcaaaagaataattttctgtataactgtagacatgtaagtttacagatctttacttgagttcatatggctgtgatagtgtttcactgctgtgactactggaagcttccttaggtattccattgtgtatggaaacggaagttgccaatcacattaaattaatttctgcctcaggaaacatgagagatttaaaatcaataaatgatttttcagtgacactgtcagggaaaatcaaatcttctagaaatttaagtcagaattaaaaatgtgttcttaaaatgtatttatttttatgtacttggctttcatatgatagtttattttaaaaaggctaccgtactttgctatgtttatacttaccagtgtcattaatctgtaaacagtgcagtgccactgacatattctttgaaccattagtgtatggaaggcctcgggagagatggtactggagatacagaaggaacagggtttttttcccccacctcaaaatagaaagggaactctgtcatatgtctttttgtatttctttcaggatgtcgctctgtgctaagcatttaattgatcttcagtagagaaacgcctaaggaactaacttagattatattaaaatagctactgaagatctttttaatgactttctataaaatgagaaagtgcactggatgatgaatgcaaaaatgaaagaaaaattaaatccatatatgcacaaaggcatttgcagagtttgcatgacagctcattcctaagtattacttatggcacttagctttctatgcagagagtaacaataacagtaatattgatcgttacacctgggcttttcaaacaagctagaacacacgtgtcatctgcagccacatgtccttcatgtgctcctgggttcatgcactgcccacggaggaaatactgtgggtcactcttaagaggcatgagttttgctgtgtcaattcaacggagcatggtttgtttgttcgtttgtttctttgtttttctcaagcacctgtttgtccatttgcatgccagtattatggaaaacattttaaaagtatgagttatgttgcatgttcttcatcttaatggtttaaatagggaaacaaaactgataacatgtaaaacagctagcaagggacatacggcattctataattgttgctcattgtggggttcgcataacgggtgctgaaatagttcagaaaattagagtttggagggcatattgtactccagtaatgctccttgggagtgatagaatttgaatgggctctatagatagatgagatttaggcagatggaagggggcgctggtcagaggcagcctcagggcatcccaggccgaagaggtcagtatgcttttctccctcatccattattgcttcttctttctcctcctacttggtttcagtcttttggaaatgagattgacatctttctctaatgattatatttagatacatttattcacatctgtacttccttcaggtggaaatgaagggggaggaaatggagagaaagaattaatgttttccattttttaaagattaagtttattcttagtgtggattacgtattactcacttgaagggaaaccttttacaaggccatctagataagagaaatctcagattatcaactgtgattagtgttttcaactgcactggaaacagaacatataagaacatggatatttttagattctgatttaactcttttattctatttgccagctctaaaaagtagactgagcaaaggtaagggtgagtgctgctgctttaaaaaagggaacaaccagcttcttgtctagttagggaatctcttaagactctgtcacatacattttagtcccactgacatattactcccacctccttgtgggtagtaaagttaaaatgttttaaatgttctttgatcgtccacccaccgatctagtagacttttaagttcaataccgcagctgggagaaaggggagttgaaattcaatttttactgttaaaaacaaggctcaacaatcatagtctgtatgtctgcaccagtttagaaattgtaacaataaattggcttccgctttcaaatgtgttgttagtcatcacactttaaattacgtggcattactatgtgtgacctacttaaaaatggttgtcccttcagtgggaacaatatgtgtgcagccattgggtgtctcgtaggccttttaaaaagctcacttttaatgcaacacattttgaacatcaacacattaaataaatacttactatgattctttactggctggattttattgggtaaagaagtgtgatcagtctttagggaacgatttagtaaacagttacactagcaaatgcctccctcttgccctgtgttaataggacacatattccagaatgatcatcggtttatgcagtatggttcctggaacaggagtccaaagacccaggcccatctctggtcttgttgttacacagcttcatggccttgagcatgtcacctaaccttatacaatatcaccttcctcatgtataaaatgagacattgcattattgtctcaataaacgtcaatctttttaacttctaaggctttaatggtcccagctatgctatagaacttcaaggaaaaacaaaaggataaatacagcagttcctggtcttgggtggctcaagcacttggtcctagttacttgggatacagttagttcattctgatagacatttgtaggcatgtctcaaaatgagtcttacatagcacccctgggtgccttccccacccctttggagcctgtattggaacattggcaggttttttttttttaatgaaataatccttaaagagaaatcagtgattgataaaacagtatcagaaattgcacacaccttgttttgctagccagaagtgagttttcaggggtgtccggtgggacagatggcgatgacatgaatcactagggctcttcgggtgagaagggcctttgctccgagtgggatgtggattgtgggcttttctgcagagacttctttccccaagaaaaccagtagaatgctagtgatgtaaactccttgttcacattgacagatgaacctttctcctcagtatgaatttttttcttcatcttgtcttttttaaatagaggcttgtttttgccctcagatcctggggtttgggagagagtgatatcaaataggaaaaaataaaacctttaaggcatcactacaaataataaatcactgctttggaatgtgaccctttaacctcattttattttcctgaagacttggattgttgtaattatgtgtgtgtttaaaacgcactgagcaaatgcatcggcgctcctgtgactggtattgtatgccatctgcagagcactgtgggggtggccaggcagggaggatgggtttgtactaaacactggatttttcttttaattttactggcacattcagtatgtacttctgtaagaatcaattttcatttcactttttggtcattttgcatgtattttgtatttatgtcccactcaagatcttctaattcttgccaattgttaattgctgtaaacacatataattccaggtagtctgaggatatggatagaggtttgcttttgttgttgtttttaactctggtttcttagattgctcatccttgacttaataaaattatacccttttcctagatattttattaaaatgtgttgtcaatccaaagagtcaccttaagaggctcagagaatccaattgtggtaaaatgtgtaatccagtaaacatctggtggttcatgttgccaggaatgattggaatgtgcctggtactttaatgaccattttaataaaatatggttatgtttttggattcaaagcaggagctttgagggttttttgtttttttgtttttgttttccaacttctctgcttgcaagggaatatctgcagattttctctacatatatgagtttcccatacattggaaatggcagtagtccctaatgagttgggtcagaatggggcagtcataactgcccatggaattctattttacattttagggcattaagggcaagaaaacttacgtatctttacctttttgggtttcgatatgagaaatatgatgcatatatcgctatgaacagaagaggcctggttggtattctttaatccttcgtgtttatagagcctgatatacaaaagaactattgtctaaaaaatctttgacaaagcaaaatatacagagttttgctatctagatatatgctatattcctacagagctttctggttaaaatgaaaccagctctaaagaatagatttaggtaacttgaagattaaaaataaaataaactagaataaacaagtcaggctttctcaaagttggaggtgtccatgaatagatcatactatctcgggaaatagtgggttccttgacctgcaaatgttcaagaatagttgtgcaattaggatgttgaacaaggggctcagctaaacgagtaaatgagtatttggagtaaatgatttttaaagtcttgttcaagtgagattctatagtatctgttttgatacagttttatacaaatatgaatattgttttaaagcagtatgactagtagcacataataaagataatgtccttgacctgtcttttgcttctgccagggttgtgtatgtggcttgagaaaattctttttctctggagttctctaaaacatggaataaagcaaaagtctggatttagtagtttgtacaagccataaactcagtttcagatttttaaaatttcagttaaaaagtcaaggtcagaatgcagtcttgtttagaggaactctgtgtattgtacccaggaaacttttcactttgacaatctcagtggcgtccactcatacccatcttccagggtgccttctagacactcgtttattggccaaacagagcagagcgcttctgaagcaggctgcgggactatccgaagtcacagccacctaattttcgatctctgtcttagctttttccttttagcctcattctcctgatctaggataactctgttatcacttacattctttaatgctttattcccacaagatctctacatcagctggttgacagctccacagataattgtagcagtcaagtggagactgaaggtctgtgatgtctttttttgaatgttgtcttggcttttgtgctgaactctgctctccccattgcctcctttttgtaaaacctgattttcccattttagtttaggtggggtttttttgcaccaaacgactttcaaactcattattaatgtctctaaattataaaatttccttgacctcctactctcttctgtcatcatttcctgtttttcttgtaccatatgtcatctcctaaaggtttttagcggttttcttcagattatatgacatttcgggtcttaggagagtgctatgttcaaaagcacagctaatacatgaatacatgtgatactttttgttaatattcttctgattataaaatgtattaaacatttgttttagcaaatctgtaaagttttaaaaatgcatcagtattcccaaagctgagataactgtgtttgaatattcccttctagtcctgtatatctgtctatgaagctaaatgatctaacctctttgtaatccctgtctctgcctacttcactgcaagaacaaacaaaccaaagcacacacataataatatgctaaagctacaaatcttcttttataattccctatggggaaaagtaaagttaatttgagcatgtaatggataacatgggaaaataggtaaatattgctgtgattctagatgaatgtagatgaatagaggaattaataaaataaaagattgtgagggtagaagactattacatacaaggtaaccttgttgagggtgttgttttaggaaatggcgacagggtaggggtgtggcagctgctccaggaggtaagatacagtcagagcttcaagggctcactagggcagggtgaaactaattccatttctgccgaatgtgcttgaagaaagactgttaaacccttggacagaagtgggaggcaatacacaagcacatgagtcccagaggcaggccgctgggtgccgtcttggaagctggccatcaccagtcccactgagccagcttcagcatttagtctaatcctatggagcattttttgtgttctatttaccaagtctcaccgcagagaatttaatgttcgtaagggagctagagcaggcaaaagtttatgaaatacaaagaaaatgaatagttcagatttatgtgtgaaaagaattacaaggcaggctgtatggagagaaggcaaagggaatattttgttttgcttttttatctttctaactgagtcaaaaagtcaggagttgactcaagtggttatagtgtgacccttcatcaaagccagtattgtggctgctttggagaaagtaaaagaaattaaatttaacatacaaacatataaaatatataatataacaaatttgtttaaaattgattccctttctgcaattttgcttcatggttggtttttttttaactggagcaaaatatgttttggctcaaaagcttgcaacattaacattgtataaagaaaagcaaattagaacattcagaccacatttataatgggtgacctcataacagtaataaatgctcctggcagaagcataatagttgctaaactaggcatgtacttatagcaagaactcctcactcccattctggaacaatttttaaattgaccttttcttttaagtggttctgctccttaagaaagtggcccgttgcaaatggatgttagtataaaatggttactttttgaaaaaaaaattaaaataaacgtaatttggttaattttatttttatttcattctcttgtttgagtttgaaatgttttggctttaggttgcatattggagacgggaacaaaaaaacctttaagactgtttaaaataggttgattttagtgctggaagctaatttcgtttttgtttctaactaggaagaatctcaggattttaagtccagaggtctgagttttgttttttagaaaaaaacttacccttgattaaccacatcttcctggagcctggcaagaggtgggtgtccaggcttgggcctgctacctttggctactcctcttggtcttagagaaggtagagatgatcatgctcacacatgtgctgtatccgtgagggagttatagattgagaaatattaccttttaggccttttttaattgaaaaagttactccatagaagatcaaatgaagtcactttaaaattgtacatttttaagctattgatgtaaatcaagcatggagaacagtttatagaactacaatggtctattaagaaaggttattcagaacatgttattcctctgcttaaaatcctcatcctataacatccttctacacttaggaaaatacatttagactccttatcaaagcttgcaagacttacttgaactgggtcttgaataccctccctgcctcatctctcattatttcctctcccactgcccaagcttcagccaccctggccatcttgctgctgtgtgaatacaccaagctcattcccactctcagccttttgtttcacccacctggaacacttcctttcattggctcctcattaatcaggggcctgcaagaatgttgtgttttcatagaggcatttttccatttattccactgcagagcccggaaaggtaaaaactatatttccctctcctcttgctgctcaggttctggttgtggtttgatgccaccgtcagacacaccatatgaggtgtgtaaggtgagtgtggaccatgagtggtaagtatggatgtgggcgtgtttcgtagacattcagccttgaagtttttctttgacctttccagcaatcaactgtttaatacctgataaatcatgttttaagctagctaactagattttgttctctgcactcatggcctgaccaacaattgggccatggccatcctctttgaaatagcactcacccactcctgccgttatgctctgtcctcttaccctacttttgttcgttaaagcacccagagcaacctgaagcaaccaatgtatttgcttattcctttgttagccagctccctcactcaaatctatgttctatgaagttagatgctttgcatttttactgctgtgtctgtctctacctagaacaatgcctgtcacatagtagggactcagtaaatatgcgttggatgtacttatttgctacagttttttggtagctgcctggagggttggagtaagaagaaattgcagattgcaatggggttcaagaaatgagcagtattattagtaagtggtgtttgccatgggttctagagcagcagagccctgttgctatgcctgccatagattataacaactgaggtagagcattgatgcctgtgtttgggaaacacttccaagcgattttgcttttttaaaaattatgttttatttagctccagagacaaaatctaaagccttctagtctgtaggaaaaacattccattttaaaatttctgtcagtttataagtcattaagttagagtttgtagagcacttactctttaataatttgaatgaggataattcaaggaatagcaaaatattggctttcctgaaagtgttgaattacatacatggatacattaataatatgtttcttagatctgcttaatctaggtcaatgcttttcaaagtgtagattgtaacctattaatgggtcattatgttaatttagtggtttgtgactagcatgtttttttcttttaattttacatgtgcaggatgtgcaggtttgttacatgggtaaacgtgtgccatggtggttagctgcacctatcaacccatcacctaagtattaagcccagcctgcattagctatttttcctgatgttctccgtcttcccaccccctacaaggcccagtgtgtgttgtttccctccctgtgtccacgggttctccttgttcatctcccacttatgagtgagaacatgcagtgtttggttttcttttcctgcattagtttgctgaggatgatggcttccagatctatccatgtccctgcaaaagaaatgatctcattcctttttatggctgcatagtattctatggtgtatatgtgccacgttttctgtatgcagtctatcactgatggacatttgggttgattccatgtctttgatattgtgaatagcactccagtgaacatacacgtgcatgtgtctttataacagaataatttatattcctttgggtatatacccagtaatgggattgctagattaaattgtatttctggttctaggtctttgaggaattgccacactgtcttctacaatggttgaaccaacttacattcctaccagcagcgtaaaagcgttgctgtttttccaaagcctcaccagcatctgttgtttcttgactttgcaataatcaccattctgactggtgtgaaatggtatctcattgtggttttgatttgcatttctctaatgactagcgatattgagggtttttttcataagtttcttggctgcacgtatgacttttgagaagtatctgttcatgtcctttgcctgctttttgatggggttgtttggttttttttttttttcttgtaaatttaagttccttgtagtctctggatatcagacctttgtcaaacggatgtttcaaacattttttcccattctgtgggttgaatgtttgctgtgatgatagtttcttttgctgtgaagaagctctttagtttaattagatttcatttgtcaatttttacttttgttgcagttgcttttgacattttcatcataaaatctttgcccatgcgtatgtcctgaatggtattgcctagattttcttctagtttttccagttttgggttttacatttaagtctttaatccatcttgagttaatttttgtataaggtataaggaaggggtacagtttcaattttatgcatatggctagccagttttcacaacactatttattaaatagggaatcatttccccattgcctgcttttgtcaggtttgttgacgatcagatggttgtaaatgtgtagtcttatttctgagttctctttctgttccattggtctatgtgtctgttttttgtaccagtaccatactgttttggttactgtagacttgtagtatagtttgaattcaggtagtgggatttctccaggtttgttctttttgcttaggattgtcttggctgtacagactctttttcggttccatatgaattttaaaatgatgttttctaattctgtgaagaatgccaatggtagtttgattggaataacattgaatgtataaattattttgggcagtatggccgttttcatgatactgatccttactatccatgagcatagaacgttttttcatttgtttgcatcatctgatttccttgggcagaggtttgtcgttctccttgaagaggtcgttcacttcccttgtttgccatattcctaggtattttattctctttgtagcaattgtgaatgggagttcattcatgatttggctctctgcttgtctgttgttggtgtataggaatgcttatcatttttgcacattgattttgtatcctgagacattgctgaagtgacttatcaggtaaagaagcttttcagctgagataatggtgttttctagatataggtttatatcatctgcaaacaaagacaatttgacttctcttcctatttgaataccctttatttctttctcttgcctgatttccttggccagaatgtctaatactgtgttgaatacgagtggtgaaagagggcatccttgtcttgtgccggttttcaaggggtgtgcttcctgcttttgcccattcagtatgatactggctgtgggtttgtcatgaatggcttttattgttttgaggtacgttccttcaatacctagtttattcagaatttttaacatgaagggatattgaattttatcaaaggtctttttggtatctatcgagataatcccgtggtttttgtctggagttctgtgtatgtgatgaattacattaactgatttgcatatgttgaacccgccttgcattccagggatgaagccaacttcatcatggtggataagtttttcaatgtgcttcgggatgcagtttgccagcatttattgaggatttttgcactggtgttcaccacgtatgttggtttgaagttttcttttttttgttatatctctgccaggttttgatatcaggatgatgctggcctcataacgcgagtaagggaggagttcttccttttcaattttttggaatagtttcgcatgaaatggtactagctcctgtttgtacctgtggtagaattcagctgtaatgcatctggtcctgggcttttttgtttgtttggttgggaggctatttattactgcctcaatatcagaactcaatattggtctgttcagggattcaaccacttcctgattcagtcttgggaaggtgtatgtgtgtatgtgtctaggaatatatccatttcttctagattttctagtttatttgcatacaggtgtttatggtattctctgatggttgtttatatttctgtggggtcagggatgatacccctttatcatttttattgtgtgtattcaattattttttcttctttattgttctagctagtggttcatctattaattttttcaaaaaaccagctctgggattcattgattttttttttttggaaggatttttcatgtccctatctccttcagttctgcgctgattttagtcatatcttgtcttctgcgggctttgaggtttgtttgctcttggttctctagttcttttagttgtgatgttaggttgttgatgtgaggtctttgtagctttttgctgtgggcatttagtactgtaaatgtccctcttaacattgctttagctgtgtcccagagattctggtacattgtctttgttctcattagtttcagagaacttcgtaatttctgccttaatttcattatttactcaggagtcattcagaagcaggttgttcaatttccatgtagttgtgtggttttatatgggtttcttaatcttgatttctgattggatcactctgtggtccgagagactattatgatttcagttattttgcatttgctgaggagtgttttacttccaattatgtgatcaattttagagtaagtaccatgtggtgataaaaagaatgtgtattctgttgtttcggggtggaaggttctgtagatacctgtcaggtctgcttgatccagagctgatttcaggttctgagtatctttgttaattttctctcttgacgatctgtctgatattgtcaatggggtgttaacatctcccattatcattgtgtgggagtctaagtctctttgtaggtctgttaagaacttgctttatgaatctggatgctcctgtattaggtgcatatgtatttgggatagttagctcttcgtgttgaattgcatcctttaccgttatgtgaggcacttctttgtatttttttatctttgttcatttaaagtctgttttgtcaaaactatgattgtgacccctgctgttttctgttttccatgtgcttttcctccctccatttattttgagcctattgtgtctttgcgtgtgagatgggtctcttgaagacagcacagcaatgggttttgactctttctccagctttccattctgtgtcttttaattgaggcatttagcccatttacatttaaggttcatattgttatgtgtgaatttgatcctgtcatcatgatgctggctggttattttacagacttgttaatgtagttgcttcatagtgttattggtctgtgtacttcagtatgtttttgtagtggctggtaaccattttccctttccatattcagtgcttcttacaggagttcttgcaaggcaggtctggtggtgatgaattctgtcatcatttgcttgtctgaaaaagattttatttccccttcactcacaaagcttagtttggccagatattaaattctaggtcggaaattcttttttttaagaatgttgagaccaggcgcagtggctcatgcctgtaatcccagaactttgggaggccgagttgggcagatcacctgaggccaggagttcaagaccagcctggtccaatatggtgaaacccaatctctactaaaaatacaaaaattagctaggtgtggtggcaggcacctgtaatcccagctactcaggaagctgaggcagaagaatcacttgaacctgggagttggacgttgcagtgagcctaaatcacgccactgcactccagccttggcgacagagagagactccatctcaaaaaaaaaaattgaatattggcccccaatctcttctggctcgtaaggtttctgctgagaggtccactgttagtctcatgggcttccctttgtaagtgacctggcctttttccctggctccctttaagattttttcttttatttcaacctttgctgaagattaggtatcttagagttgttcttctcatggagtatcttactgtggttctctgggtttcctcaatgtgaatatttgcctgtcttgctaggttggggaagttctcctggatgacatcttggagtatgttttccaacctggttctgttccccctgtctctttcaggtaccccaatcagtcgtaggttttgtctttttacataatctcatagttttcgaaggttttgttcattccttctcattttttttccctctaatcttttctgcctgtcttacttcagcaacatagtcttcacctctgagattctctcctccacatggtctgtttggctattgatactcatggttgcgttgtgaagttctcgtgttgtgtgtttcagctccatgaggtcatttatgttcctctctaaacgggttattctggttaacaggtcctgtagtgtttcatcatggtttttagccgctttgaattgggttagaacccactcctttagctcagcaaagcttgttattaccaccttgtgaagcttacttctatcacttcatctgtctcaggctcagtccagttctgtgcccttgctggagaggtggtgcaatcatttggaggagaagaggcaccctatttctttttaattttcagtgttttttctttgattctttctaatctttgtgagcttatttaccttggatctttgaggctgctggcctttggctggggtttttgtggtgtcttttttgttattgttgttgttgctttctgtttttcttttaatagttaggtccctcttccatagggctgctgtggtttctggggttccactccacaccctattcacctgggtacctcccatacctggaggtatcaccaggggagtctgcagaacagcaaagatggttgcctgtttgtttctctgggaactctgtcctagagggacactgacctgatgctagccagaactctgctgtatgaggtgtctgatgacttctgttgggaggtttcacctagtcagggggcacaggatcagggaccctcttgaagaagcagcctggctgccccttggcagaacaggtgcagtgggctgaggggattcccacttttctgagctgaccagactcctcagagccagcaggcgggagagattaaatctgctgaaccagagacagtggccgcccctcccgtcaggggctccatcccagggatcaagagttttatcctaaatccctggctggagttgctggaattcatgtggggagaccctgcccagtgaggagggatggatcaggtcccacctaaagaagtcagcccatgatctgccacagtcgctgtgcttcactgtggggaattcctcctggtctaaactgcccagtctccctggcatcagcaggagaaaacggccaattggagccacagtgatggcagccacccctttccccaagaacttggtcatcttagtctccagcctgctaccgctgtccacaacccgagcagctgctgagagtctgcacagctctgtgcatgggacccaaggccctggtagcgtgggttcacaaggggatctcctgatccgcaggttgcatagatacttggaaaaagcgtggtttccctggtggggtagtatgatcactctccacctcccttgactggaggtgggagttcctcttaccccgtgtggctctcaggttggccattgttctaccctgctttttcttgctctccatgggtcacgccaaccacctcattagtcccagtgagataatccggatccctcagctgaaggtgcaggattcactcactgtttttgttcctctgggtgggagccacagaggagagctgcttctagtaggccatcttgacctctttcttgactagcatttcttttattaaaatgcagtagaaaatagagggtattatgcatatttgcatcttttatgtactgggtcatgacgaaaatgttgtctgttacagaaggttagagtaaaaacttttggaaaaacacggagagacagctgtgtggtctgtaacttataagtgatggctctactcagaggtactgctaagactgaaagttagaaatttttctgtggaaaaaaaaaattttctaatttttttttcaatcccaggcctagagctgccatgaggtgctatattcagtattcacataggtggaaagtggagagagagcagttaatcacccttgtattgagctaggtgctttaccacagtctcttatttggcccttccatacaatgtagaggaattactgttactctcatccctaaatcctaagaaagaaaaggaaggtttttctgttgtctttatccttatatcctctttgccatatgtgtaaagaaggaagaaagagtaagtctgaggtttaaagtgagccccattaaaactgtaaattagtcaggattcctctgtctgttttccctttctcccctgtctccaggatcagactgggtacctctgccgagattgtgaataaatattctttacataattggccaacatttctttaaaagcaaggtggtttattacctggtacaagagcagagaaggaaatgtaggtggcattgcctaatctttcctctgttgccctgagcaattcagctctagccccaaactttgatgtcctacttggccacatactgcagtcattgtgacctgtcttctgtggaagacatcagtatctgtctgtttgattcaggctttcctttttgcgtctcttacttcccatcccaaacttttccatctcagactgtactcttcggggaagaagtataagaatttcttcctagcttactatgtttctaatgagccttattttattataatgagctaaaattggcaggaggtaacaaacatgggccctgaatcccagccgtaccacttctgacctcaagagtgttatcagtcatatgagctttgctgtctcatctggaacatgggagtgatgataatatctatctcatagtcttgcactttttgtttttataagatcattgattaaaaagtattcagaactgcctggcagtagtagcaagtgtgtgtgttgtggggctgtcaactgtaaatcccaatcctccaatctgccaagataagtaggataagccctgccctgaagctgttggattaatttagtcagaaatcaatttcatgaacacttcttgagaatctgctacttacctgttgctgtgggctgtgtatagaaaacttcaaggagctgatattcatctagaaaagtctcatagacttgacacaggagcagagcagtataaaggggtagtgctgctgttgtgaattgtcgggtaggttttctggaaaggggaagagggtgagctttgaggcgtttttgaaggatgggtaggatttggacaggcagagaagaatatgcaaaatcagcacaacgagagagtgagtatatgatgtgtatacatgtgtggagtggcagctgaatgggaataagcgtaataggaacatggaattgcaaatgagaagtagtcaagattgcattggatagaatgcagtatggaaaatcctgatttcctaaatgagaatttgacttagtagtcaagaatctttgcctatttcttccctcattcccttataaaaattaaatttaaatgccagtttattaatttaaataaatgctgtctaagctggtttaaccaggacattctttcctaataggtaactaagaaaccatataatatggtatactcagaaggttgcttagctggtgtggcatcaggacaaaggaagctagaggtggtgactgtttaatgtcatgaagcttaggcagcttgatgtagccatttccagtgaggatgtgtttgccaaaggtccacaaacctcacagttcattagatgcagcttctatatccatctccttgctaggtgattgccagctggatgaaaaatatatccaagcccattagctaaggctttttctcccctggattgtgcatggatgggcaccaccagtgctcttctatatggcttttttgctaatcttctttggctgacaaatagtgaacaatgattatttctttggatattgaaatgactcagtcaagttagaatcaattccttttagtttgttgacctatcctgttgttttaaggttttcttttttttaaccaatgtgtgtttgtgtaatacatagttataatagaacaattaggaaatataaataagcaaaacgagaaaaaattcttccataatgacaatttacagcacaatattgcattgtgtatttactaaacagcttttctgagtaacaaagaaccctaaaatcttaatgggttgaaacaggtattcatttcccttttcaattactttttggtggctacagaacggctgtggcagagctctgctctaagcgtcttctcgttgggagatccattttgaaataacagttgctcagtgacaagcccttcctgtggtggaagggaagaactggacgctgagccaacctatacagtgcatttaaagctgctggaatgggacatgggccctatttgttcatagtccactggccaaagcaagttacatgggtgtggtcaacatcaatggagtaggaagctttccttgggaaaccttgggagtaggatatgcagtagatatttgtgaaaagtagtatttttgatactcttgatcacaaatattctttttccacatacaaaatacgtttgtatatagcaatacaacaaccacattccactttcttgatcacgaatactcattcccctccaaaggcagaatatactcaactcctccccaaagaatagttacccagacatagcctatgtcactttctttaagacttttttaatatagatatagatgaacacatatttaagtgtggtcttcttttttacctattaatatactaaaaagatctttacatatcaatatgtatttcaacagaattttaatatttacactagatttcattttatatgccttatgttatttaacgaatttttttttttttttttttttttttgcttgagacagggtctggctctgtcacctaggctgaagtatagtggcacggtctcagctcactgtaacctctgcctcccaagctcaagtcatcctcccacctcagcctcccaagtagctaagactacaggcacacgacaccacacccagctaatttttctatttttttgtataggcaccgtcttaagccatgttgccctggctgatctcgaactactgagcttgagcagtccacccggcttggcctcccaaagggctgggattacaggcatgagccatcacgcctggcctagtccctcatttttagacattgttattgttttcattttttgttattttcaacaactgcttcaactaaacattttttcatttccttaagaattactgagtcaaagaatgaatgcagatgtttttgtgctttttatttgtattattaatacaataaattgtcatctaggaagggtgttccatactatttctgggccagtttgactgatgaaattagtactcattgtctcgatttgcatttttggtactagttaatttttatttttcttatgtttatggaaaacttgctttcttcattttggggttgcccatttattttttccaatttttaaattgagatattcatctttttcttagttgatctccaaaacctttttattttttttaaacattattattacctttgtcgtatatgctgcttatatttttgctggtttgtcttttaacatattatttttctactttcagtttttaatcataagctggacaaagacatgaatgttgtaggaaggcagaatgaaaagaacaaagcaatagaactagataggaagtgtctcagcaacttagcagaactgagatggaaactcacaataaggttctcttattggggccagacatggtggctcacgcctgtaatcccaacactttgtgaggctgaggcaggcagatcacgaggtcaggagttcaagaccagccagcctggccagcgtggggaaaccctgtctctactaaaaatacaaaaattagccgagtgtggtggcacgtccctgtaatcctagctactggggagggtgagacaggagaatcacttgaacccaggagacagaagtttcagtgagccgagaccacacaactgcactccagcctgtgcgacagagactctgtctcacaaaaaaaggttctcttattttcctttatacacggagtttaaggtccccattgtgtaagttcatcttgctagaactggtcctctagtaaagggagattcttcatttagagtctagtaagaaaaataaatgtccagagtaaagcacattcttatttcagtaaagggttgtgtgaagctatggcatttttcttaccctttagttgccaaatggtctaaagaactactagcgttttaaagagaggaaagaaatgtatctgttttcagttggaaagtagcattttggtacatcatgctttgctttgtttcttgctttttcatctttttggcatcttttttaaagatcttatctgccaggaagttccttttttcttttttttccctttttcgtggatcagctgctttttggaatcaatgccacaattttaggaccaaatcagtgatgctgcagtagtttcagggttaaaagcactttggttaatgtgaaattcattgtcaaatatacttcaggacaaattatgaaaatgatagcattgagattcagctgtatccatttctattcatggcttaatgaatattttcaggcttagtgttatatattctcattagcaacatattcatgttattttacttattttaaaaaataaacaactaaaggttagccaccatcttctcggaaatattaacagcatccattgtactgcagtcatccagtcttctgtggaagtcagttgcatgttatttactttaacaaagaatttcatgtccaagggaattctctatatgggatctcttttctctgggtgatttattttcactggcaaaatggtacgtttctagaggtttgtgtgcttatgagtttggtttaaacttttccttgaaaagtaaatgcttgatcccctcagagtccaaccacctagtgataatgaagaactgaaggatagttatttcaatttcgacgtcttaaaagtgcttaatgagcaccttttcatacctttaaggggacctctctgtgtaagtctctgaaggcccttgctgagacattggttcatcagtggcaggctcatttgcatcttggtccctgagcggcttcagtgtgttttacagctgcagaatgcactggaaacttctgcccctttgtagactattaattcattggggagaaaagccctcgtgacgaggcagtggcatctgctggtggtgttgccttctttttcttgtattccttttttaaccaaaaagttaagacatttccttcagctctcgacactctcaaataaggagagttcctcccattaggatttttcacagttcttgcctcagaaaaacacaaaaatcaagataataccagaaaagacatggagaaagacattttaggagaacatgaaaatggctatagcaggcactacacaaagcagtaaaatgcctcttataaagagtacctatagctgtccaagcgcggtggctcacacctgtaatcccagcactttgggaggctgaggcgggcggatcatgaggtcaggagatcgagaccatcccggctaacatggtgaaaccctgtctctactaaaaatgcaaaaatttagccaggcgtgatggcgggcaccggtagtcccagctactcgggaggctgaggcaggaaaatggtgtgaacccgggagccggagcttgcagggaaccgagatcacaccactgcactccagcctgggcaacagagcgagattccatctcaaaaaaagaaagaaagaaagaaagagtacctatagctagaagagaaaaattgtaatgctcccaccacaaaccaaagataaatgtttaaggcgatgaatatcccagttaccctgacttgatcattgcacattgttgtgtatatgtgtcaaaagaacacacatacccctaaagtacgtacaactatgattcacaatacaaaaaggggaaaacagtaccaattaaggtaaagatgtgctaccaaagatgtgctaacattttacatgatttccatctcataactcttagaacaacccataaagtaggttacctatgtacataaacacacaccaaaaaatttcctccatcaccaaaatcaggtgatgttttgaagtcatccgggagaatgtggatctgagagatacatttccaatatatttcaagatgatcttaaacatgtagaaagacctgtcggttacaaattgattatttcagccttcctctacagatggacaagttattggtgtaaatacatggcagctgtaaatatcagtcggagtatctgaagtcactcccaggattcctgggaaaacattctgccttgggaagtaaaatgctgaaacgaatgcactcttaaaggggttttgtttttgcttcttttttgttttcagctctttcatgtaatttcacataatttgtaggcaaaaatcccaagagccgtaaatggtcctgtgaacatagtatttcacaccagtgatattttcatgtttttttgtcggttgaaaaaacctgagatgaaatagtgttcataaatctctactttgtacgtagatttttactccctcaggaaagctcatggctatgcagttgtaaagctcttatatttggtaaatattaaagcaaatattcacttaaagtcatactccaaatattactgcataaatcagtgcatttaaagaaagttcacattgacaggcacgtgtatatatcctttaaacatcttggaacttactctgcactactaggaagccacttttttgtttccttcaacaatggaagacttcacttaaatgatgagactagtacatacacatttggtttaactggactgcaatataaatgttcagcttaccctattgataaacgatgtgattgttccattctgtataaaaggtttcttgatacatagtatgttttcaattgtgtaagcttcataaaggggcttgttgaaataggttactgtatatgagtttaaaatttatagcaagctgaatgagacttgtattgtgtttgaaattatttataccaactcaagagacacagcatttcttgtgaccaaaaaaaactattttacttacagtatacaagataaaaatgtttcatgtggccagtcacagtgacttgcacctgtaatctcagaatttggggaagttaaggcaggaagatcacttgggcccaggagttcgagaccaacctggacaacatagagtgatcctgtctctacagaaaaaaaaaaaaaaaatcagccaggcttcttggcacacacctgtggtctcagctacttgggaggctggggtgagaggattgcttaagccaggaggttgaggctacagtgagccatgatcacaacactgcactccagcctgggtgacagagtaacaccctgtctcaaaataaataaatacacaaaatattgttttatgaaattatagagttttaaatttccaaagaccttggagattataacatcagtacagatatataaactgaggtctggagatgtaaagtgactcttccaaggctgtatcacaggatggtggcattgcgtcaggttcactcaaatgttgtgaatcttagtcctgcatcctttctactctactgtttgcttacccctagacggaaggaaagaaagaaaaaaccaaaggaaagaaaaagactgaaaaaaaaggaagttgcagtattctacgtattggtcttcagtgtgatggtgtgaaacccattggtgtttgagttgagaggtctcgaggcttggcttctgttcctggttttcccccagtatgtctgctaagagaccatgttgtgcttatgcttattcttagctccggaagcacattgttgattttctcaaatattgttttcaggttattagaagtggagcagaaaggtttaagcatgggagatagcctctcacgagtgttcacactatttcagcagtatgttatatctttaagagcttgatccttaagaaacaaccgtactctagaaagtacatcatttttcctattactaataatgtatagataactcattaataggaatctgtaaaatattcttatttttggccaccgatatgataaattcttggactttatgtaccttttaaagtacatctaattaagtgattaggaggtctgtttttaaagggaaacagggaaagttgctgcattattgtctgggtttggtttttatattgtatattatctttaatgttaatacaacagtcccaaaagatggttgctaatttcaggttctgtttctctaattcttggcctaggaaaatgaaaataaggtttgactgaaataagattctgttcaaatgtccttgcaaatgaggaagcctcacattaccaattttttcccaggaattttattgttgattaactgctgatggggtagaatttatagttgagaataatttcaaaaagttaatcagttgccaatgggcttagtaaagaaaggaaaatataggagcggaatctgcagcttgatttttgtggtttttttttttgggtggggatctcattattgtttgtacaatgtgtgttactgcgaaaaaccctaatgaactttggcttaaatactggtaataactaaaactgctcattctcccagtgtgaccacccaccattctatagcctaccatgcctatccaaaagtttataattaatttatttttatatcatttgaattctttttcctgtattgcccagcagtctttacgctacctgaaatttttaccagaaatgacagacattccagcacatattttctaagggcactatccttcatatagagtattcggtcaagtgagtagaaggttagtcaaactcattcaatataagtccccagttttcactacactctatgaattgttatcaacctgaaaataagctcaagaaagaaatgttgggtcgtcttgcctgactgtgactaggtgtcttcatctgagtaggctacattactgtagtaaatgatctcaaattgttgactggctccaacacagtataagtttgtttcttgtttacatggttgtcaaagctagatattcctggtgaacagattgcttctttttgcaaaaatacagcagcctctttccattttgtggcatcatcatcttcggggacttatgaatttttctgtatttggcctgtaaaagtaaaatgagtagtggctcttaaaaagcttggcctggaagtggcacacatagctttcactcacattccttagcaggaatctagttgcaagggatgctgagaagcagtctctggatgttcccagaaacaaccctgtaccatgggaggaagaagggatttaggtggacaaacaggcatctctgccacaccaggtaaccttttcattcatttccttatgagcctggttgagtggggtttcatctttgggtcttcagatgattaatattaatacagatttactatctctcattaatgttaattttaaatgatagtgtttctacatattttctagaaaaagctagtacttttttattgaaacttatctcacatattattgttcctgcatataaaagctaacacagaactccttaatcctaattaaatagattagttggaaatcaatacacctacttctgacaaagaagccacatagatataccatcttggatgttacttgtatgattataggtatatctgtttgctattgctactgtatcaaattaccataaacttgttgtcttaacacaatatattagctcataggtctgaaggtcagaagtccaaaatgggttggcagggctgtattccttctggaggctcgaggggagaatctttttgcttgtcttttccagcttctaagagctgtctattccttgattcatgaccccctttctccaccttcaaacctcttcttcccttctgcttctgtcatcccgtcttctctgactctgaacctccaacctcttttgtaagaacgctgtgaggctgagcatcatggcttgcacctataatcttagcacttcgggaggccaaggcaggaggatcacttgagcccaggagttagagaccaacctgggcaacgtaatgagacctcatctctacaaaaatttttttaaaaaattaaaaaatgttaaaactaggtgggcatagtggcatgtgcctgtagacctagctacttgaaagattgaagcaggaggctcagttgagcctaggagttcgaggttacaatgagctatgatcgcaccactgcacttgagcctgggctacagagtgagaccctgtctctgaaaaaacaaaacaaaaatacatcctgtgtgcccactgagacaacccagggtaatctcttctccttaagttcgttaacttattcacatctgcaaattctcttttgacatataatattcacagagtatcataaaaatcttgtgatctgagagttaggacatggacatctttggggggaccattattcatctttccacaatagataaattatgtacagactttttctcagagaaaagtgatgcaacgatgaaatggatttttgtttgcttttcagaaaacaatttgctgatcagactgtgctgtgtagtgacgaaatgttgatgccagaaggaactggagaggttatttcatccaacactcacatttcctggatgaggaatctaggacccctaaaaattgatagatacttgcccagaggtaattcacgcaatcacaggcagagctttgggaccttctggggattttaagataaaggaggagagaaggtgccatgttcttttcttagaactccatttaaagcattttgtttctttaagtaacaataatgttctagaatataaaatgttcccaagttgacttctgatagcaacgaaatgttttagtgaatcatggacctcagaccttaatactgtatataaaagaaacacttttctataatgttctgcagagcactcttgtttacatagactgtcaaggagatgggctccatatttaagagaaaatgttttgagtcttatcacttgtcaggtacttttgttggccagtcaggagtggatggtaaaagtactgacaattctcttatctcattcttagcccgttgtttcctaccctctcccccttgcctgtgatacccagtattgtcgccactcaccccatgtcgctgtcgagcagttaatacctggctagtccaaattgagatattctgggagtgtaaaatacacaccagatttcaaagactcgtgcagaaaaaataatgtaaaatatctcattgtttttattgattacatgttgaaataacttcttttaaatttgataaaatagaaagagagtcttactatgttgcccaggctggtctcaaacccctgggctcaagtgatcctcccacgttgtccccgcaaagtggcaaagtgctgggattatagacatgagccaacgtgcctggcctgaaatggtaacattttggatatatggggcaaacaagatgcatcgttaaagttaattttacttgttttctttttacacattttaatgaggttactagaaattttaagttattatgtggcttttatagacttctattggacagtaccattctatacttttccccagctctaatgatgttccgatttgaggcacactactgctcccttatcctatgagaatcagatatcttagaactagtgcagtaaaaatggagtatttcttatttgtattcacaagctaggaagctcatcatatcttgatgagtgactgtgatacttattataatgtactaagacctttgtaattctggggaaaatgcaattagtaatatctgaattaaagaataatttaaaagaaatgcacttttatttgctcctcggaatgtatcttaacacaagctgagcaacgtgctgcttagtaaaacaggccacacagagtaattgaaagagcatagtcttgaggatccaagtagattcaacattgaatccaagctcctgtcttagctgaaaagctttagacaagttaactacttcctctaaaaccatgtataaaatgggactgataatatctatctaatagtgtttgtcatacgtattaaatgagataatgtgaagtttccggcctgtatgaaattccctggggaacagactgagtcgtatggaggtgaggaggaggtggaaaggaagcaggattgggcagagaggaacggacggcaatgccatctcaacaaaggcctctgtgaatccttgcagagctctgggaccggaggtcggtggagaaagctagagaggcattgacacatcctcagatgcaggtcctgtctcccatgaccctgggccaggcaccttttttcatctcagggcaattctcagcgacagctgccaggtgacgctggatgtgcccttgattcctgaaggggtgtctgggcagctcagcacagagtctacccaggaatgtgcattccccccgttcctgttaccagcttgcattacacatgagagagggtactgttctggtcacatgaagttatcattgttaatttatccatttgacttgtttcatactccttcttgttacagacaacattttttaactcatctgttccaagtttctgtaatggtctttctagagtgtagtccttggaaaagaactgtgaggttacaaggtagataaattcaactttacaagataatgcaaaattattttctggtatgtgtatatacccaggaagagcaaaaccgttgagattggtgtcctcaagaagtttaatggtgatggttatgttctgtttcatgtacttggaggaatgtttaagggtgttttttattatttctaatatcttgtgtaaatattatatgtattgtttcgtatgtgtcagttattacataataaaaatgccccttaagggggaatagatcaaagttatccacagttctatggaatccttcaggggtcttctggcatacatggaagaagtctaatagtttgtttctacagtatttgatatactacctagtttggtttatgacatgacaggaggcatcaaagatgctgttatctttttacttcatgcatgcacttttatgtctgcaaggctgatttggggctgacaggtatcaatgactgttgtgtctgcagtttcctctgagagagattaagatttcatttagattgtcagccttcacatagccagcccaagttgtgatctcaatattactgtaacattagctctcatcaggcctttgtcgttgctgttctttgcaaggaagctttctccctctgctagggatctttagtctaaaagtctagaaggctaaggatccctagtagaaggggaaggagtagttttacccctagagaatttgggaattgcacagcctaactctggtcccttcctgtcttagagggtcttttttcctatccatttattgtttccttcttatataaaaatgtattagatttttttaaatatctaagagttagtatttttatgctataattttcctccatacctttggccagctccaaggatcccttgaatcagtactaccacatgaaaacagtttcatttatcagaataattttttttttcagtggagatagggtttcactatgttgcccaggctggtcttgagctcctgagctcaagtgctcaagtgatccgcctgtcttggcctcccaaagtgctaggattacacatgtgaaccactgcacccagcctatcagaataattttaatttattatttaagaagtgaaagaagcttccatctagagaaggaacttcactttttttttttttttcggagatgcagtctcactctgttgcccaggctggagtgcagtggcacgatctcggctcactgcaagctctgcctcccgggttcacgccattctcctgcctcagcctcccaagtagctgggactacaggtgcccagcaccacgcccggctaattttttgtatttttaatagagacagggtttcaccatcttagccaggatggtctcgatctgctgaccttgtgatccacctgcctcagccttctaaagtgctgggattacagacgtgcgccaccgcgcctggctggaacttcatttttaatttagttaatttgagttttgtagaatgttttctccacaggcttagggaacagtgtggtggtagcagatgaggagagttggctggcaggttagggctcaggtgggtgtggtgggcaggtgttgaagggaccaggaacattttattgatgatgatttactgtgtggtgcctcaggcttgagtaggtaccagtgtcttcttaatctttgtcactgaaacaaaacactggcttgaggtgctctagttaccttactgtttcatgacacttggacaggactattttcagatcccaaattcttttttcagatctttcctagcattcagggtccagtgttactacccatcatcactacttacctatcagatgccatgctaatgcttcatctctgtttgccctgcaccatctaatataagtcagttgtaatagccaggattcctggctccaaaaacatggaaactgacctttaataacttaagagtaaaaaggaatctattgaaaggtcatcaggtagttcacagaatggaggaggaggctattttgaggatcatattagaaaaatagacttgaaccaaggaggctgagtgcagaggaaagtgccacgttgcttccgtaggaaaagtgtggggctagtagcctgcagttgccaccacaactgcaacaggggggctctgtcaccgactctgagtctttacgccacttttttgagagcatcatatggccgggcttaggtcacatggcttatacctttgtttccagcttacagggacagggaatacctgaagatttccgctaaagcaggatgttgttttggtgagtagcctaaaatcaacaaattttaatacagcatgtttccccctgtttttaagtgaaatatagagaatttcaggaacttattcaatgtcactgaccagtcaatgacaaagccaagatatgaacacaggtccgtttggctcatagccattgcgctttgctgccgccttatgtgctgttgacctggtagaaaccatgatttggggcttggccacattgaaatttggatgaggcagagtatgaaatagcaaatctgttgggtttgtttgttgtatttaaggtcgtatgtgtcaagctggtctgattcatagaatccctactcattgaggggtagcagcagtacaaccagcagttgggggaaatgtgtttgaaatagccctgtcttctccaaattttgtggtgttctgctccatttgagaagttcatcatctccatgttttatgtagcccggccttcacatatgtcagcgtctgtttcagatttttctaaacccttcaggaatttacttgaggttgagctagtaccagtccaaactcccacctggacattctacccccggtagtgaatttctgcagccccagagcttagctttggtattaaagtttgaattttaattgttccccaactatctgtactccatcctttaatttcagagagaccttatccagtgaggagttaaaataacatctatataatataggcagtttggtttactgcccttttgaatataaaggccgaagatacatttggttacagaaaatgtgcccaaagtgacaattcttgcagctagccaaacatcagttactgggaagaaaaaaatgaataatcccctcaaaattccaatcaggttctgttactactttttaaagtccctttgatagcttttcatcatctttaaaaaagcctctcatcatccttcttaaatatatttctcagctcccgctccattatggcctgattttcttctggttgctcctgcttttaccttttacccctccgtcagagggccttggcacagactgctgttccctcttttctcctgttcattcttcagatcctgcctcattttctaaagtcctcagggaagcattcccagacttccttaaggccaggcccattccaattgctgtcagagacttccagagctgcagtaccttgtgattctcttccattgtattggcacagttactgttttacatttattttgggtattatttgattattacttattgattgattaatgtctatctcagtgtcagctcagtgggaagaggaatctctctggatttgcataatattttattcctcatgcctggcacagtgaatgagggaagttaaaatgttgaacagaatttaaacagatgttttgtcttttgcactatagagcttacagttactcttacattgtaccaaatggtcacccttttttgatgaaactaaatatggcttgacattattaaggactgatagaaattcataagtgacccagactaccaagcaaactaatcaaagaaatgaaaaatgaaatgttggtaattttagaggacttttgataaatgaaaatgagacagcaaaaagtggctccctctctgtctctgttcaaataatctttttttagaaaaaatgcacctagggtcatgtacttcgactggcattgttttttacttagagaataatttgtctttgatgtgaagcacaagggcagggatctctgatcattttattgcctcctagattcaatgattggcatgtattaggcacttggggaatatttgttgagttgacactagatgttagagataattatggacgggcttattggattagcttttgaaacagtattttctcagcactcacccttttatatacaattattggtttactcatctggatgaacagctttggaggctgtgaaatagcatttctgtatttgcattttgtgtttactttgggctagaattaagaataccttcttgtagcacagaaagaagagtttataatgcctcaggtatatagggtaagtttttctgatctccggaaggccctgtagcttcacagttttgtgtttgttttccatatgatggttggaaaggtctgagctgactgtggcattgtcagctatacagagttaagtgtgtgaacacacagaggccgtctttgttctgcattgtccgtacttctaaacagcaaatctaatgcatcactctggtctaaaacatcttacatgactggtcttgttcatgagggggaaaaaatgaggtttttttccaggttcaaaactgtttaacttatacgggtgttccccctgccttaagaatgttatttcatttgcaatgtaagaacgttctatttaaagatttttccccccatcctgttgctttgtatgtttgaggaacagatggaatcaaaagcgtgtgatgctccaggaagattgaaggctgctggagtgaggtgatgcgtcctcataggttgtacaaatcataggatttttttttttttactcctaaccgccaattcttatagtgattgttcattaaggttgatttagcttagattctagtgatgtcttatggactaaggaaatccgtagccccactgctagaaaaaactttgcagttttatgtccaattgagatgggtgaaggcaagccttattggacctttctgagaaggggcaggggaaatcaagggaaggggctctgaagctggttcagcaggctggggtcgaagggtgacggaccagacagcgaggaagaggtagcccggcactgtgggccaagtgtttattctgggagaaagggtctgagtcccgtttaggaaagcggtggtgtgtccatcaaggtggtaggttagtgacacatggcagcagggttctggtgcaggctcagatgtcaggcagtggagcctgtatcaggcctcatgtggctggaccatctaggggataagaatcctgtcctggggtgtagagtgttagaagaagctaggctgccaccatctgctggggttcaaaatagatccctagactagaaaagtattagctggaaaggcctggaagaagacaggaaaaataaagcagtacgttttgatccaatgtatctgttttcctcatgataccttgtgtgtttatgtatccttaacagtagtagctatcgttctctgcaaaattaacttgctttgtagtcatgttaccgcatggaaaggaatagcactcagagaacgaaaggttgcgtacctcactcctgccaggtcaaggacagggagctgtcacatacgtttcaggactccaagaccagttcctacgctattggtacagttgattttgtcctttcatgtctccttttcgtagttcttatgagtagctggcctctatttcacttctagagtcagtctcccagccttgaactttccatttcaagataacctttcaggccttaatgtagtctgaagagatatgtgttcgtggaatatttagctttcaagaaacaaatagcataggaggaaaaaaagaaacctcaatattggtaattaagaaacctgggcccaagtctcagtttggtcacttcatagttatgagctcctggacaagtcactttgtttctgtgtctcaggagtcatctatagaatgaagagattgaagatgattcttgctgaggcctctcccagctctaataataagtccaaatgaatagtctaggaaacaattaatcattagcatctttataacagcagcactagcctcttgaatatgttgggctacgtgacaaacatggacagaaaatcttggcaagcccctgccctgtcactcccaaatcagcctctgtcactttactctgtttcagtacaagcaaatgtaatgtgaggaacctagggaaagtcatgagagccttttgaattaactgagtgttacaaccgccattctgttctgaaaataggctgaggctgagttcctcttgacacctcatgcctctcttccctccccagtccttcttggtatcctgctaattgtacctctagacaattggtatttataattcatttccactttagcttttctccagagttcatacctcagtcttcacctccttctactaatggttctgtgagattttcttagcaaagagggaagtgtctgcctgggtgccgtttgatactctcctgttgatttcacttgggatctgaaagcctttcagttcattgatactctgaagatattcatcattataattatggcaacagaatttcttgttctctctacctcctacccccgactgaatgtgagctgctcaaagttaggggcctgatggtatcagcgttgtgtgtccccagcatctggtacctagtagacacagcaaagaagtgtattgagttcatttctctggtactcttttgagaggttgagtttttctgatgaccattaactaggtcccttgttagaagccttttagggtttatctaccaaacggtgtccttagagaaagcatcagaaggtgaagcaccagtttccagccttccgcttaattagtttgcttcattaaatgtctcctgctattttgatttgttatggaagtcaccttcactttctgctaaagcttttgtggaaagttattttgtacctttaaacagctgcttctctccaggaagcctgcttttattttatagcaagccggctcggctgtctctgtacaggctggctcatgtctataaatggtcaaggcctcagagccagatggggcaggacagggtcatccaacacgtctttgaagtgattatttcatattgaatctagttgtgaaccccatatgtacctaacaccatgattgtgggtgataagaaataatgtaggatgaagaaaataagacttgttcagaaaacaattggaaaactatgttgtttcaatgttaggatgtgatacattgcaggggtattattcactgcatcattattgtagcaaaagattgcagactaaatgttcaataataagaccctgttacaatatgatacattcacatgctcgaatactatgctgctattaacaagagtaaggcggctttgtatgtgataatgtaacaggattttgataagggttaaaagagcaagaaatattaagaaggccaggcacagtggctcacgcccataatcccagcactttgagaggccgaggcaggagtatcgcttgagaccaggagtttgagactagcctggacagcatagcaagaccctatttctaccaaaacaaacaaacaaacaaacagcctgacgtgatcgtgccaggtgcatgcctgtagtcctagctactcaggaggctcaggcatgaggatcacttgagtccaggatctttgctcatagctgcagtgagctattatggcatcactgcactccagcctgagcgacagaacaggaccctatctctaaaatataaataaaaatagcaaaaatagaccaagcgtagtggctcacatctgtaatcccagcactttgggaggcagaggagggtggattacctgaggttaggagttcaagaccagcctggccaacatggcgaaaccccatctttactaaaaaatacaaaaattacccaggcatggtggcaggtgcctgtaatcccagctactccagaggctgacgcagggagaattacttgaacccgggaggcggaggttacagtcagccaagatcatgccactgtactccagcctgggcgatggagcaagactccatcttaaaaaaaaatagcaaaaatatatatcatgcttccatttatagtccatgagaagaaaagggatgggcaagcgcacacacacaaacccaaacacacacacgcacgtggacacacacacgtggatggcttattatctctggaaggatgcataggaaactgggaacagttcttgtttcgggcagagggactgaacaggaaaatggtacgggaaggaaacaaatttcacttcatacttttttgtatagttaggggggaaatcatttcgtatttattgtattcattttttcagaaaaaaaaaaaactgctaaattttctttttttgagacaggatctcactgtgtctcccaagctggagtgcagttgtatgatcacagctcactgcaacctcaacctcctgggctcaggtgatcctcccaccccagcctctcaagtagtcaggaccacaggtgctcatcatcatgcccggctaattttttgtattatttgtagagatgggtttttcactgttttgcccaggttggtcttgaactcttggactcatgtgatccgcccgccttggcctcccaaagtgctgggattacaggagtgagccactgcacccatcctgaattttctttaaaagaaagttgaatgacgtgagagccgatagagaagggaaacttgtatatttaaagtagttcctttatttgacagctggtcattgagctccggctcttcaccaggttctgttttggcctctgagatgcaggtaatttcaaacagctatgagtgccctgaagtcacagaagtaggggttttggtggcaaatgaatgactagggtggagctgggctgctgtttaaggaaggatggtcacagaaggtccttttggaaaaagatactgagctgactgctgaatgaggagaagccagcttagtagtgaatcaggatggggcaacagagttccagacaggatgacagcagatggagggtcattcgggaaagcttcagaaaggaggcaagcttgccttccatgcatgggctgagtggaagctaaagtgccacgcactcacctggaatgaagagtcaggcctgactgacaaagataagaagagtgagaagcggttgggattaagtttaggtcagtaggatgaggcctgagcatcaagggcccctggatgctgaggtctgtacagctttttcaggtacctcttgagacatactcagatatgtcgcagggatcatctgctgtgagactgctagcagcattgtaggagttctcttcactctgtccacgtagaaatacgtgttctgcaacagagagtaaaaggcaggagcagaagaaaactttctctccctgacttgcagaaaagctcatggcaggtttaaaaaggacagggcaatgcagacagctatagtgtgagggacacagcgtggttcctggtatacttcatgcgagaatctgcatgctggctctgtgatagcgtcctcatcaggaaagtggggattgcaatattacctcaacccacttcgcagaattgtcatgttgagagtgaaaacaagagaacaagtggcttctgtaaggtattaggtgttaaacagatcgatgaaagtggttattagtggagacagtacaggagtaacgtcaattgggcagtctttgggtaaagatggcgtccttctgctaaacctcccagaaatgacatgtatcagattccatttctgtacatcctaccatatggttttagtttttgttgttgttgttgttgtttgtttgtttgttttttaatctaaccattttggtggagaaaagaaagttcatcaggagatagtttataactcctcattatgatgactgacaaatatccaaagggcatgtttcttttaagcccgtgcactgtctttatccccacacagaggcaggcgctcatgtcttttacacgggacattttgaatttttatctttattatggtattagtttcttactgggttccacctcaagcttacttttgttaactggagatctttacctgtagactcgtcgtctgcttaagttagaactaagtctattccaaatgatcgattttattttactgctatagtacaccactttttatgtctttggaatatgctttgtaaaatagtaactttacagaatttttcttaattctgagaaacagttatttggtagcttcagtttcctaagaagagaggaaaatgtacctcaaaggacaggagagtccccaagatcttccaaaacctattccaaaaataatctattattattttagatggtaacattttaccaatattaatgtcttcgtcttctttatagcacaatagaagcactaagtgctttaaaaataggagatgaaaagttaaaaaaaaaaaatgtaaaggatataggaagaaagcccctgtcatgaggatgcaacaaaacccaagggtcaaacatcaccctctgctgggcctgttgacagtagagggaaacagttacctgacattaaaacataactttagtaattaaagtttaagaattactttaaaccattttttaaaaaattaattatctcaaataatgctcaagaacaccagtgcgttgcaaaatttgaacattggtacattgtaaaaaaaagtgtatacattcttgagttgtaaaggaaaagtttaaatctgaggggtgggatggattgaggctgacgtttttcccagagtggtctttgtaaacaatgtttaagttttgttatttatattaacacgaaagcctcctttatctggagaacacgcttatgtggctgagcctctgtccctgggatgccagatagtgagacatcgcaatcctgagtagtatgctcaaaactcacttcatatgttaggagctaaaatggtcttgttttctagtaatctccagtttgtgattcgtactcagaggcttgcacattgctgtgtacactgacagaacattgatggcttttggaaaagctgcttgctgcttgttgcccggagttagctttattgctctcactctgtgccatattgaaagttaacctgtgctaaccccccagtcattttctcagtctcctagagaggtaacagaacatctttattctggatttgccgtacacactgacataattcctcttgaaatatctggctgtcgtagtctaaggtcataagaaacatttaattcttcagaatggcaacataatttgaattgctgtcaaacagtgtgtggcctgaaacgggaaagaaaggaaaattattgatcattgagatgcctttgtgtctcgcatcgtttcactagcctgtaattaattgagccttttgacgtccatccatattttttttcttccttgtggaaattcagctacgttcccaccccacatggtgccttggagattacttgagacttttatttgtggtatctctatttggttgttgacattaatgagcttacttcacaaatatcacaagagaaatagtgttgctttttggaatgttaatgaattgcttgcctggccaattgccattcgttccagtgtgtgaatatgatggggtgtgtgtgtgtgtgtgtgtgtgtgtgtgtgtgtgtgtgtgtgtgtggaaaagagagacgagtagcaggggtggattgcatttttttcctctttgcagccagtgacgtgagctgtgcctggaacaatcagactcgctgcaaacagggtagttgaagatgctgggggaggcagcctggtgcttcttaagctaacgcggatcacggcgctcaggagctgctcaggcacaaccccgcagagttcctccagcgtgagagccttggaacggttggaaagtgcctttttatttctctaaaccccttccttagttgaccttcgaaaatgattggcgtgaatagtgtccagagtgccagcaaggtacgggtgaggacctcaggttccgtgaaatactcccgggaggattctatccggcggcagtctcacaggtcaaagtccatgaaaatttccaactcctcagagttttctgctaaggagaacaaggtaaagaaataccacattgaaccttattgacagctgtgtggcagggcaacagaattggatagtctttggcagtgtctaatgtgcagtgatagactgagaaagtaacgaggagtataaaatggttctaagagaatcaggtgcgatcaggtgaaacggatgggacctgaactccagatacaaagatgctgtggcatgggtcagttttgtaaagagccagtttgtggaagagatgggcgaaagccgtgctcaaaatgagatgactgtgggaaactgttgtttggcacatcgatcttgtttttggtctcagaaaggttgccttgacaaatgatttttcagtgcggagtatttttagaacatcaggaatacagagatattgtgtatgattttatctttcagttagttcctttttcctttcctcccctggtcttcccccagcccccagtctgtggagctgatgtacaagtatgacctggtcctattatactacattcatgtcaggtttagagtggttagccccaggcatatgtaatgaagagaaatttcttctttcatgttccttacacatatatgtgctgatgctatgctgccatgaaaccactcgtgtttttgcagctgtcttgaagataatataatctttgttcgtgtgaaatgtgaagggagtgattacgtagtgaagtgggcatttactacatgcaacatattcttgagattcttcccaccaccatctgtgtgagcagggtactcagaaacactcccactccacaggtttaaaaatggaataatagaatcataggatcacagaactccaggtctggagatggagatgattataacggagattcatgggcttgataatgtgcagagagagcgtcaggaggtggatctcagtgtcatttcagccttctcggggttatatccagacccactgagagtgacatcaggctttcttcaccctcccaccactccccactgccctcctcctctgctacctccccatccctgtgtgacataacattattgaaagactttggcattaacaggttcccctcaaaatatggcaggggacaggtggcaaaataccttagtgtgactttaagaaatatgttggcttcctattcacccccttacattatgacatagtggagtctgaccccctccgtcattagcaaattgcctggctccagtaagtcttcaaatctggctttttactcctcactgtttttttaaaaagctttatctttagagagaaacgtgtcttcaaagtcctttaatgtgacctgtatagggatgtgttggcttctactgaaagtgttatgagaccacctgtggtgtcaggactgcggtctcctgctgaaatagaccagaatggtttatcatattcttaaataaatgtatgtgagcatgtatgtaattctcaacatggctataaaattggcttctataagagcactaagagacgtctctggattttgttttggatgttttaatgtggagtatacccatggtatgcagtcagaggctatgggaaattaagagctcatcatccttaactctgttgtagtcctactacctatcctcatgataatttaggcattgtaatattagtgggttcacccagaattatggttgtgtagtgtaatgttggaatccagcatagataccacatgaaaagattctctactgtcctctgtgtttgtcacacagtacaggtacttttacttgatatgtatctgtggaagagaaggccaagcactttttttttttttttttgaatattgcaaacgccgcaggagttaacagtataaaaggccactggtagaactgtagtcagtaggccatcacatgataccttaaagattatagtcggtttttaagagatgattagtatttttttgaggcatatgtggtccctaagttacagaatatgtgttcaaggatatagccaagctcccaatatctcacaagagatatttttaggattatctagtggcttaaaattgaacaccagagctaagagaaaatcagtagaatagaatattctatcagagtgaccctaatcattgactagccatttatattccctaaatgaaataaactgaataatatgacaggcttgtaccctaaattactgaacttaattatactataatagacatgtgtaaaatgttgatttaagcatcacttctcccatttttatccacagttacacgttttcctccaattttaatcagaattttcattgatcttacttgtatctagtagtattttttagcccttaaatcagtgtttcttcttcctcctcttcttttttttttttttttttttttgaaacagaaacaatgtctcagtatgttgcccaggttggtctccaactcctgggctcaagcagtccttccacctctgcctcccaaagtattgggatgataggcacgagctactgcacccagctggtatttcttcttgctaatcatgtaaacagcatttttgattatctgactctttcatccaaaatgcaggatgtctaatttgatgattagaagatccccattgccacctctctccaccctctcatgtcatcttcccaacctgtaaaaaataagataccattaactcgtggttcgctcctgggatttaatgttatctttctagaactctggctctttctagaataggtgtaataattgcttctccttgtcagagttggaattacatgttttgtattctttgaaactttcatctttgatgtttccagcttgttttcttggccattaaaacataatggtttattcaaatattaattatctgtagtcctcacttgttctctgatttattcatattcatttgaaaaaaagtgttaaaggactgtggaaaggattagaagttttgcttttaattttagtgagatatcttaaatgcttttcttggtctaaatattttaaattaagaaaattgaattttccagtactttatggttcatattgacctcgtctgaagaatattatttaacctactaaaattcagcttatagatgttattttctttaaaacccccttctccgtgttgactttttttctttattctgtgtttaaatcttaccatttcctctagagagagtgtggctttgtctttttctcgataataatgtttgtatcaacctctgaagcacataatatgggcaggatgcaaatctgaatatgttttggaagaacatgtgtttcgtggagaccggcattcattattaaaattaatgaagtctgactgagctcagctcttcattgggtgtctgttattggaagagttactagcaaggcttctggccatgagggggcagtgcagaccttcctgctgtcagatccagctggttgctctgcctttgacagaagtaacattttagaatcaattagattctaattgatttctaatttagaaacaatttcctaaaagtagaatacaatcagccccgggtattcgggtacccttggggtttcaaaacccatggatatggagggccaactgtactccagaatttggaatgtgcagtattagaaaatgttgatttaagcctcagttctcccagacatttccacagtcctcctctgagtctaaatatttgtcaaatataaattattctagtactaatttttaacttatggtttaaaacataaatctgtaaaagttcatgttgataaacactcttttcttccccatctcttgccaaactacgtgataccgtttaaatgaggcggaatctcaaactgttgtttctttatgttgttgtaggtgaatgtcacatgagtggattaatataacatgcgtggctgaatccttgaggccttttttgaggaataagcatgatgctagagattagatcaagaattctctagttaataatgttgattcaagtgaaccgtttaaagcttttattcagtgatatagcaaagaaatcaatttctgtgacaccgaaatttcaagaacttccagtaaagtactggtactttggttggtgcatagtgaaacattggcctgttggtttctcagtcaggatgccgcatcctggcgggctaccctggttttgctttctaagtagcaatgttcacctagacaagttacttcacctccccaagactcatccctaaaatgcagggttttgacaaaatgatatctttgttctgaacactgttaattttagaaatcttgccgaggttggtggggttatttcctctgtggaaggaaccttaaagactgagctagatttaacaaaggtagttttatatgtattctgaataaacctcttcctgtactaggagatgttaaccataaacgtgttaaaggaaaatggaagtcctttgctccaaacctctgctctgctaagtgcctaatccattgctttttaaaaacgtgttgcaataatgttgaaaggcaccatcacctctattctccccattctgcttaggcttcacttgctgtttcctttgcattgttagataactgctaatcattgcttcctctgtgagttaaagctatacacaaagaaacctgaagaaatcattacaatggccctttgcgacctgaagttttggtggcaggcttgcagattgttgtcatttcttcctagaccacttttgctctttagactaaggctagagcctgggaaggagattctggtcaaacaggacattgatatctgcctattttaaaatggagaaaattcttagtcataatatgaaaattttcttgcaaatgtctttacatatttttgttattcctaagttgaaggagtacatttttaacctcataaattcatcctttagctgaatagactttattaaaagaaaaacttaagcatatatacattttcaagagtttgaacattcagggatgcataaattagggttgtaccaaaccacaaggggctggcactctgatgagaggtgcaagaaggaaaacttttttttttttttgagacggagttttgcttttgttgcccaggctggagtgcaatggcacaatctcggctcaccgcaacctctgcctcccagattcgagcgattcccctgcctcggcctcccaagttagctgggattacaggcatgcgccaccacgtccggctaattttgtatttttaatagtgacggagtttctccatgtttgtcgggctggtcttgaactcccaacctcaggcgatccgcccacttaggcctcccaaagcgttgggattataggcgtgagccaccacgcccagctgggaaaactcttatgtagtatttgcagaagcaaggcgaagagaacagttttgattggctggaagttagttggtggaaagaatgataggcagagagaaagaaaaataaattttttaaaagaagttgatggtttctgattggtatattttctagtttccatttactgtttacattggcctttggtttgttcatgtaaaaatttaaaatgccagaggtacctcagtctaatgagctcccaaggagaattttttttaaacaacttaaactattaggtcaaaatatcaacatcctcctgcactagttctaatcctggcatttgaaggaattagggaggtggtgtgttgaacaaagtaaatctggtagtgcaaagataaaaacaattttatcttcagaagcctatttttcttttcttggctctcctatgttaagttatactttttcaccaggtattaattattctgccagattaacatgttctaatgttttgtgggtttttttgtttactttgtttttttttttttgagacagagtctcgctctgctgcccaggctggagtgcagtggcctgatctcggctcactgcaagctctgcctcccaggttcacaccactctcctgcttcagcctcccgagtagctgggactacaggcacccgccaccacgcctggctaattttttgtatttttagtagagatggggtttcaccgtgttagccaggatggttttgatctcctgacctcgtgatctggccgcctcgcctcccacagtgctgagattacaggcgtaagccaccgtgcccagtcaacatgttctaatgttttactgtgatccttagccaaaggagatcttaaaaagagacctgacttcttcagggacgtagttctacagattatcattatctgtatcattttcatattatcgataactgtttattccccttaagttgatgacttgagtcagacttgccccaaaataaaaactttcactccttacacaatattgctctgtcttctaggccagagtgcaatggcctgacctgggctcactgtaacctctgcctcctgggttcaggcaattctcatgcaccaccacacccagctattttttttttatttttaatagagatgggtttttgccatgttggccaggctggtctttaattcctggcctcgtgtgatctgaactccttggcctccaaaagtgctggcattcaaggcatgagccactgcgctgacctggttttatttttgttaggaaacctagcaaagtgacaatggtttttgttactgggttggtttgttagagctaccccctgctgcccacctcttaatttccctccttcctctagttcctctgtatctgtgaatttctcaaatcctgctggtactttcatataaataaatgtcttttttaagattgctcaaatgattacttaggagtaaatgttgagcacactatgctcctgatagagtgatatttcttgacccttgaatttaattaatagcagatctttacgatcactgtttacccattttcacttgagtaaagtgtaggtgatgtgtttggtttggatgtctctgttacagaccgcaggctctttggcttcccatgtaatggaaattaacatggagccgagcagatttcccagatgaggctttcaaatcagggcttgtgctcaagcacaagggagacagtggaggtgaggcacagggtcctctgactggctctgcaggaagcagcagggggaagctggtaggtgtttttttattaggcaaagcacagatattgttatcaaggctaaagtatacaggcttggctgggcaaagcacaaaagaggggtagggtatgcgggtcagcatatctggttgtaatagttatctcgagtgatgggctcctcgctggtctggccagcagcaacaaggctgtaaatcaattgttcggcatttcctactcaggataggacactccacaatcttggtttcctgttaaatctcctaaggccagtttctggactaagtgaaacatatttaaacattatgagagcagagagaatggctcttttctttgtgtgactaagtcctcagggttagcgggtatggcatcagtgaggtggtagaggtgtgggttttgtgaagagaagaagaaagaaatacatgaaggagaagccgcgtcccactcctgttgtgtcatctctaactcccaaggtcgtactgcattcttgctcccctccatttatgagtagactgtatttgaacacattcttttggggaaggtgtactgaagcaggtgtttgagaacttccatgcagtatttgaacattgtagagaaaatgctggtccatgctgtcattcctggcaagcttagtgtaatatccttttcagaatccagggaaaggaaaaagaaaactctatgcaataatgataggagtcgaaagagaaaaaaatatatatatatttgcattttaaagatagtcactgccgaagatcagggagtttcgtagcatcatgataacctgaagttgaccataaggagcttctgtgtgggaatatgtatggtgacaagctattctgcaacctgttgttagatcatgcctggcttagagcttagggattgcgtccagcttagagtctaataggagatttttggaaaatattttttatttactcatccatagtgaagcagagaccaagagtagctgtgcaagatggcttcctgcttgttaatttatgatattaatttatgatggaagttgctcttctaacattaattttaattaagatttttaagctttgccttaactatcattcaagcagattttatttctttttttaaaatccactgtaccatgttccgatggtacatttagtgtacctgtttggacacgtagatcacctgatatcggtggaatttgtttttctaggtagattctttgaaatgcttaatatcaaaatttttctgaacgggctggctgaggctctagtcctagcctgactccccttatgacatgccattgtttgtagcctgcagttaagttttacaacatgaaatgccccccaaggcactggaaacactagtgtactcgttactgccacattcaaatctggtgagccaagtgtgtgtttgattccagtaaataaataagattacgaagctatctcaaacagtctaatctccttcttgcactcagctgcagtttagtggtgtcagcgtcagctctactactcagaaatccactggggcaggccaaggtgtttacaggaagcagtaagaccttctctagatcctggtgccccagtggctcatgacaagggaacgaatccttattgagctttttcattacagttttcttctaaggtctcccagcataagtaaatctaaagggttgaggtcctacctaactagacgtacagatacaagaaagtactttgagagaagcagctcttgactgtcactccgagggacagataaaggtccagcagatttatatagattgatgacacttttctttattgttgcttttttttttaaattggagacagggtctcactttgtcacccaagctggagtgcagtagtaagaacatacctcactgtagccctgaaatcctggcctcatataatcctcatgcctccacttcctgagtaactaggcacatgtcaccactccaggctaatattttaacttttttgtagagacagaggacttacaatgttgcccagtctggtcttgaacaccccacctcagatgcttctcccacctcagcctcccaaagtgctgggatcacagacatgagacaccacatctggccacacttctttcttaatacatcttcttaaaaacaggtaaaataaaaaggccatttggaatactcttactatggttggacagtgttttgaggagattttctgtgccccatccaccccctgctgtgatctcttagactgtgattaagtggtatttacatatagcaaaaaaacttaactcttaaattagaatttaaggtaacagtgtgcttttatctttacacccacctaaactccactaaaatgacagtaggattcgtagaccttcaaggacccaaagaatgagagaggatttttcaaaacatcagcaaactttgaaacatggaaaccagatagacgtgttcactatttaagttccacagaaaaaaactggatgccaaatactaaagaaagaaatagatcaatctgtccccacagaacgcagggaaggcccaggaactgggggccactggctacctctgagggcagtgagtcgaacgaggacagccctttaaagcctctaaaattagtaagtcgaccttctgaatgccctcccctgctttgatagccgcatacccttcctcccaccattttctttttttttttaagacaagtttcactctttcatccagtctggactgcagtggcacgatcactgctcactgcaccctccacttcctgggctcaaggaatcctcccaagtcctcagcttccagagtagcaggagccacaggcacacaccaccatgcgcagctcattttttaatttttttgtagagatagggtcttgttttgtttcccaggttggtctttaactgctgggctcaagcaatcctcctgccttggcctcccaaatcgttgggattacaggtatgagccagcatgcccccctgcccgccctacaattttctgttctttctctctgataagtttaatccagaggttttggacttaggaaattaggctcagtcgaggcccacggggagatccccacgttgaaaatagcaggattcagtgaaaggtataaacgtttcacagcagggcgtctcttccctctctactttctcatgtactttttctcagttgcttgaagaagtgaaagagaagacatggtgtccagtagagcagagggggagagggaatccccaggacaatggcaaagggaaaccctgggacaacagctgtgccggagatagaaaccagccagattagaggagtgggggcagagacgatgccaagagacatgcttccaaccatggcaccgaaggaatgcctgctggagggtgtgaagttgacatagagatagattcgtagaaaactgagtaaacaacaacaaaataagatgatgattaactccagggaaatcaaaaatcttacaaaaaatggaaacgtagcctagtgttctgccccatgaataatgtctatatagtcacaataatatgaggactgaaaattcatgaaactgcaaattgtgactgtggtatgattttaatatgggagtggaaagaaagagacgggcagggtgtgtgtgggtgtgtgtgtgtgtgtggatgggtgtgtgtgttaagagaaccaaataaatgttcactttccagagttctgcagttgaaagtcaatagatcatattgaaaatagaaaaaccaaaaagagattgaaagaggtgacttttgagcagcaagaatcagaggtgaagttaaaagattatttgtattacataccttttagtaatttttgattatataaatgatatacatatattgccttgagaaattttttttaatgaatcagaaggaatgtagacagcatatataggtacatacgagactggaataatttccagggactagaatggcttttgtttatcttaattaactttgggtttaacaaatgccaggtaatggagactactttttaagaaaagcaaaaggtttcatctcttccaagactttatactctagcagttatcagactagaccatgttctgctgctagttgctgtcacagttttagtctatagcaaaatatcagtgaaaggctggtcctttcttgagaaacagttgtctcttctgagattgtccatgcaacttatttttatgcaacaataccgataatagttggtgctttgtttctttaaaaaatttattttctcatttagctaaacgaaaaactggcaattctatttagctccctaaaatttcttttgcaaattttcctgtttatgaaatttgaagcctgctatccactgggtgagattatttaatttgtttgtattgatcgttttgaataaaacctatttccatttggtttgtcttcattgctttgtctaatgcatggaaatgacagggaacaaatgccaggcctggcattctctctaaatgtcaaagtcccccagggattgttttttttacaggccatttatttaaaaggattgtgcttgttacccagcaagtttttttttttaataaactgtgcacgttaacttcatcatgtccatagttattaaatataattgaccgtttttcttgggtacttaaaaaatattgcatatatttacaaggtcactttaaatttatgttttcctatgttctcaaattgcattttttattatggtacatgcttgctactttccaacacttaaggcttaccaacaagatggacattaacaaatttcatcaagtacattccagaatctttattgaaaatactggttatggttatgtttttcactgatatggtttagctgtctaaactagacaagtttttgataaattgataaattacagtttcagaggatcagggtataaaagttaaaaacaaaatcaggcccggcgcagtggctcacgcctgtaattccagcactttgggaggccaaggcgggcggataacaaggtcaggagatcgagaccattctggctaacacggtgaaaccccatctctactaaaaatacaaaaaattagccggacgtcatggcgggcacctatagtcccagctattcgggaggctgaggcaggagaatggcgtgaacccaggaggcggagcttgcagtgagcggagatcgcgcactgccctccagcctgggcgacaaagcgagactccatctcaaaaaaaaaaacaaaaaacaaaaaaacaaaatcaggagatgactgtgaacacaatggcttctggaatcatggtgcttccaaagaagaatagttaaatctgctgtggaataccttggaagttaacctttaattcattgtataagaaagaaagtgattcactcagatcataactacattacctcttggaaagagagttgtggctggcatagggttgccagatttcacaaataaaaatacagaacacccaggtaaattttaattttagacaatttttagtgtgtctcatgtaaaattggagggcatgcttatgctagaaatgttattatttatctgaagttcaaatttaagtgagcatcttgcatttgatctggtaactttcaacctacaccaagcaacaatctgcctaacctccagctcctagatcggcgaagtggagtcatcctacttacttcctaggacgtagaagcaggtgtgaatctaggtctgcagctttctagtttattgttcttttttcctgcctttgctgcctcccatcataattgtgttatacagcatcgtcctcactgaagcccttgccttctcagcaaatgaaaccctcgctgtggttaagacaacttacgaagcattatagagactaaagggagatggaagacttgatctcatctgcaaggagcataaaatctaatgtcatctctatttttcatcgaagaagcaaagtgtacactgtgtggtcaacattcaaattgtccagaagattatacattgaaaatccccccaccctgctccccgagttgctgtgtccggagtcagtcattgtcggtggggttgtgtgtatcccctcagaaatgttctattcgtgcccagatactcgcacacatttttcccccacaaaatggaaacataccgtaacaatgttttgcaccttacttctttcctttatctcttaatgtatttacctccttcttagcttaaatgactttaaatatcataatgatacatttctggtgctactgttgaaactgttcgttgtacccagttttttatttgtgcttgaggtatgtgaaaatggtccacctttctcatataatttagaaaaacagcctgatccgtccctaatccgccactgcctgccttcatcccagtcaacttacctcacctctcacccagattccacctgcctcgctgctgtttccctttttctcttataatcctttctccacacagaagcggagccaccctttaaaaacatgaattacagcaggtcaccctcccgcttaaaatcctctagtggtcacccggccagcacagaataaacctctaacttttctggtttaaaagcccttcgggacctgctcacaccacagctgggcccatttgctccagccgcaccagccccgctgggtttctcagacccacccggttcagtggtgcccaggagctgcttacctcgctccccacacctgtgcgtggctgctcccggtcactcacgtcttacgtttccttgcccagaggccttctctgaccatccaggctacggctactctttccagtgaccttatttgaatcaccttataataattatctggtagcctaccagaaagtgacagaattatcgtcatctgttatttttcttatttattacctgcttccaccccactcaaatctaagttctgtgtctgttgttcaccactggattcacgatgcctaaataaataactgttcaactgaatatatgaatgaataaatgaatggttttaagggatttatttttactattataagtgttacaaacatgaattagtcttctagttgttataaaatactttactgtattaatacttataccatatgctataccattacgggattcgccccttatctgcagtttcaggtagttactcatggtttcacttaactgccatcaaacatcgtccaaaaacattaaaaggaaaattttagagacaaacatttcataagttttaaatctcatgccatccggcgtagtgcgatgcaatctcactgtcgtgtgccatcccatgtggacgcgaatccttcctttgtccagtgcctccccactgtggatgctccctgccctcagtcacttactagctaagttggttatcaaattggctgtcacagcatcacagttcttgccttcaagtcacccttattttacttaataatagctgcaaagtgcaagagtagtgaagctggcatatgttatcattgttctattttattattagttattgttaatttctttctgtccctaatttacaaattcaaccttataagcatgtaagtctaggaaaaaaacatacaatatatagggtttggtcccattcgtggtttcatgttccactgggagccttggaacatattcccccaaggatcgggagactactgtatcagaaaaagtacattctaattagtgtctagtagttacaaaaaacaatttcccttcatatatcagcatgtgttataatcaaatatttgttgtggtcattgtacaatagactaatacaatgaggatgcattaagcaaggtacgctatgtagggagatggagtagacaagttataaatagtcagtgatgtgttaaaggagaatttgaactataaaccatcaattcatgtgcactgtgatcataagttttcttagccgtgaacttaggatgatggatatctttccctgtgaaaacattattttttaaataaactaataagaaggcctaagctgatataacaaaaggaaaagctaagaaatgtaatactgtggatagcattgtttacttttaactttattaactctgatttctaggcaagacatttatcagagttgcaaaatttattactgattatctatatttaaaataatatgtacacaggtgtgtatgtgaacaatacacataatactgactttaaagtatgtatatatgtacacaggtgtgtatgtgaacagtacacataataatatacttacatggtgacaatattgtgttgtgattagggcagttaaaagcagagactatggcttaggaaagacctgtctgagatacccagctctgctgtatgaccttggcagcctacttaaccttcataggcatcagctgtggcatttctagagtgggaataatactacctctctcatatatggctgctgtgagagttcagtgagatcaagtgaaagtcaggctcttagcagtatcacatagtggggcctcattgatagttattatcagaggaagatcagttatttgaaatggctagaacatcatcgcagcgtcagaaataccaggcgaaacatgaaatattcagaagtttgtctataaatcaaaaattggaaattttgccgtgtttgttcagtgattcttactgtttcctccttacaatttctaatcacagtgagaggtgacagcgtgctggcagtcctggcagcccttgctcactctccgcaacccctcggcctctctgcccactctggccgcgcttgaggaacccttcagcctgccgctgcactgtgggagcccgtttctgggctgaccgaggccggagccggctccctcagcttgctgggaggtgtgcagggagaggcctgggcgggaacccgggttgcgcgcggagcttgcgggccagcgcgatttcttggtgggtgtggcttccgcgggccccacacttggagcggccggccggtgccgctggcctcgggcagtgaggggcttagtaactgggccagcagctgtggagggtgcaccgggtcccccagcagtgccggcctgccggcgctacactcagattctccccaggcctcagctgcctccctgcggggcagggctcggaggctctgcagcccgccatgcctgagcctcccccaccccgccatgggctccttgccccgcctgagcctccctgacgagtaccgccccctgctccgcagcgcctggtcccatcagctgcctaagggctgaggagtgcaggcacacggcgggactggcgggcagctctgcctgccgcctggttcaggatccactgggtgaagccagctgggctcctaaatctatttggggacttgaagaatctttatgtctaggtaagggattgtaaacacgccaatcagcaccctgtgtctacctcagggtttgtggaggcaccagtgggcactctgtatctagctaatctggtggggacttggagaatcttcatgtctagctaagggcttgggaatacaccaatcggcactctgtatctagctcaaggtttgtaaatgcaccaatcagcactttgtgtctagctcagggtttgtaaatacaccaatcagcactctgtatctagctaatctagtgggtaggtggagaagttttgtgtctagctcagggattgtaaatgcaccagtcagcaccttgtcaaaatggaccaatcagttctctgtaaaacagagtaatcggctctctgtaaaatggaccaatcagcaggatgtgggtggggccagataagagaataaaagcaggctgcctgagccaccagtggcaactcgctggggtccccttccacactgcctttatgagctgtaacactcaacacaaaggtctgcagcttcactcctgaagccagcgagaccacgaacccacaagaaggaaaaaactcccaacacatccagcaagaccatgaacccaccgggaggaatgaacaaactgcggacacgtctcctttaagaactgtaacactgaccgcgagggaagtcagtgagaccaagaacccaccaattctggacacaatagcattccaatctgtttcaaaattggtgtcctctttgatagtggatgtgcttgtctcacccacagtagtttacattgctctctctgttgacatacttgaacatttgccagccttgaataatgtgtgcttccagctacttccccccaccccccaaaaaaaagcaatagtgaagctacattcccacttggttgaaatcaggctacagctgagtgctagcttaccttgtacatggagctttctccaaacccccggagtctctccctggccttcctgacttatctgttacgagatatttgagttgtaactcttagtttgttttttgatgatgaaccagcatttggacttaatgttctaatcagttcattagatgtttacagttgtaactaggggaaaaattctttaaacaggcagaccttggagatactacaggttcagttctagaccacagcaataaaacaaataccgcgataaagcaagccacaggaattttttggtgtccgtatgcatttagaagttatgtttacacagctgggtgaggtggctcacgcctttaatcacagaactttgggatgccaaagcgggcggatcacctgaggtcaggagttcaagaccagcctggccaacatggcgaaaccctgtctctactaaaaatacaaaaataaacaggacacagtggcgtgcccctataattccagctactcaggaggctaaggcaagagaaccacttgaacccaggaggcagaagttgcagtaagtggagatcgtgccacactgcagtccagcctgggtgacacacaagactgtctcaaaaaaaaaggtatgtttacactatactgtagtttattatgtgtgtcattggagccttcagcaagttgtcatcgttttgcttatggagggtctcaccttgatgttgatggctgctgactaatcagggtggtggctgctgaaggttgatatgactgtggcaatttctgaaaaggcagtaattaagcttgctgcatcattagttttgtttgtttgttttttaagactgggtctcgctgtctcacccaggctgaagtgcagtggcacgatcacagctcactgcagccttgatctcccaggctcaaacagtcttctcacctcagcctctcaaatagctgagaccattggcatgcacgccacccacacccagctgtagactctttcatgaaagatttctgtgtagcatttgatgctgtttgttagcattttacccacagtagaacttcattcagaaatgcagtcattcccctcaaaccctgctactgctttatgaactatgtttatttcatattctaaatccttttttgtcattttaacagtgttcatagcatcttcaccgggggtagtttccatctcaggaaactactttctttgctcatccatacaaatcctcatctgttcatgttttaccatgagattgcagcaatgcagtcatatctttaggctccacgtctaattctagctgtgttactgtttccaccacatctgcagtgacttcctctgctgaagtctcaaaccccccaaagtcattccatgagggttggaatcaacttcttccaaactcctgttgatgttgatattttgacctcccatgaatcacagatgttcttgaagacatccaaaatggtgaatcctttctagaaggttttcagtttactttgcccatatccatcagaggaatcgctatctatggcagttacagccttgtgaaatgtatttaaataataagacttggcagtagaaatcacttcttgatccatggtctacggaatggatgttgtgttagcaggcatgaaaacaacagtcatctccttgtacatctccatcagagttcttgggtgacgaggtgctctgttaatgaccagtaacattttgaaaggaatccttttttctgagcaataggtctcgacaatggactaaaaatatttagcaaaccatcctgtcaacagatatgctgccatcctggctttgttgttacacttaaagagcaaaggcagagtaagggcctcaggattttcagaatgatacttgagcattggcttcagcttaaggtcaccagcttcattgccccattgcccctaagaagagagtcagcctgacttttgaagctttgaagccaggcattgacttctccctagctatcaaagtcctagatggcattatcttccaataaaaggctgttttgtatatactgaaaatctgttgtttagtatagccaccttcatcagtgatcttagctggatcttctggataacttgctgcagcttctccatcaccggttgcagctttaccttggacttttatattacagggtctgcttctttccttaaacctcacgaaccgacatctgttaccttcaaacttttcttctgcagctttctcacttgtctcagcttttgcagggtggaagacagttaggtccttgctctgaattaggctttggccttaagggaatgttgtggctagtttgatcttctatccagaccatttaaactttctccatatcagcaataaagctgtttcactctcttatattttgtgtgttccctggagtaacacttttaattttcttcaagaactttttcttttcatttacaacttggttaactggtgcaagaaacctcaccttcagcgtagccttagcctcactaagcttaatcatttctagcttttgatttaaagtgagagacatgcaactcttccttttacttgaacagttagagaccattgcaggattactaattggtctaatttcagtattgttgtatcttagggaacagctggtcagtgcagtgctcagaacacataacatttattaagtttaccatcttatgtggagatggttaatggctccccaaaacaattacagtagtaacatcaaagatcactgattaccatagcaaatataataatcaaatgtttgaattgtgagaattgtcaaaatgtgacagagagatacaaagtgaaactgtgctgctggaaaaaaatgtcactgacagatttgctcaaaacagggtagccacaaaccttcaagttgtaaagcattatcgtatacgtgaagctcagtgaggcaaagcacaatacagtgaggtatccctatacttaaaacctttactctacaaagaacttagcagcaatcttaatgttttgtttacatttagaatagtgttattcatactagcatagttaagacactttctctgagacacaacagccagttcaatagaaggtaatctcaaggtgaagcaaaagtagtttaggagaaatgtgctgtgtttgaatacatcttattgatcaagtccacccccaaaataaataaatgaatgcatacacacattagtaaaactttgaagtattatgttagtacaaaagataattagcaattacatttttattcggtttttttttttttgctttttggttttttgagacaaagtctcattctgtcgcccaggctggagtgcagtggcatgatcttggctcactgaaacctccacctccctggttgaagcaatcctcctgcatcagcctctaagtagctgggactacaggcacgtgtcaccacacctggctaatttttgtgtttttagtaaaggctgggtttcgccacgttggctaggctggtttcgaactcctgggctcaagtgatcctccctctgcggctcccaaagtgctgggattacatttgtgagccactgcgcccggccttcactttcaggtttgattttgtgcatccccagagatgctggccatattctttggcaggtgtgtttagttagtattgtctttggctaccttatttttcttcagtaataatgaagaaatggtggttcaaactgttgtagctcagaaaggtgcatttgacaagaagcagtcagagtcccattgctccccttcccccacctcataatatttctctggctttcttgctgtagctcccactccctctcctattcttgttcgttcatttgcaattttaaaatgtgcatttattaatctgtaaaagctgtgcctaggatttgagagcaggtagtcatgctattgatcaaaaaccatggcaaaaaatatttagtgaggaacacaggaaaagggagcagagactaaagaaaggactagtttgggagtttggctgggtgatagctaaggtctttctcaagctgaattgtaaaatagtagatctggaagggggcaaagaacactaactttatgcagccctctcctattgcatgtaaagaaaatgagggccaggtaaattgatttgtcttaaatgtacaagtcagtgataggtgccccacccacccgtttcaaattctttgctcataagattggatctgttctctgttttatcaaatctttctctcaagaaaatatgtataacataatgtcacatattagatactgtgtgtgaaagtgtctcacacattgtaagtaggaaaaaaattagttgactccattagctgactaattcttcactaggtaaagttcagtcagggttagcagcacattttgtattccttatataagaggcctctgaagacagaacagattcatctgtacctagcataatgcctccctagcctctggaatgtgcttaaaaatgattacatgatgaattatacatattaattatacttcagattctctttcaataagataagggcttgaagagtaattttctagtgttcattaatacgaatttgtgctgggacatctattcatggttaggtggttttgggactgtgactgggtttggaagtacatcacaacataagactaattgcccgagatacagatttcagctctgtttacatgttgactcgatttcaaaactacatcttaccatagaagtgaaaaaaaaaaaattcaagcatgttctattaccctaaataagagctgaaaagatgaatgttgaccaggttgcttatgaatatacattctctaatgtggcgctctttaaacttgggcatgtgaaaactgtccagtgggtacgggagaacacaaatagcttaaagggaatccatttccagaaactcatcttctgtatgtacttctccctaaaatggatctacctgtgaattctcttgtggtcaagccttcaggctatttctccttttgcatctctgcttaacaattgccctttgccacttaagaaaaaaaagtcataaccctcacctataaccttatttggtacatcgcaaggtgtaaggacctccactggtgcggagggggcaaaaaaagagtcaattccaaatcctagttttggagaagcttcctatagtgagagatagtgcagtttttcaatattattttaaggcatagagacgatagtagaagttgaagaccattgcaaagtattttgagtttttctaaccattttgatatttatctaataactggttttatcattaatttttaaccagtgtctttttcaaacatgctctttctctgataacactgccagagtggtgcatatttaattctatacttaacagtctgcttgatctaagtatctgcatgagagccagcatagcatttgaaagagagaattgtggtacggatggtgtcataattctttctgagtacaaattccactgcggtcactgtcagtttcactgaaagtggaagctgtgatatcctccatacttttcataatgattcaggaaccacagagaaaaaaattcattggagtttagagatgattgaactaaaatacacgaattccatcaactgtgcaaaatatgttggagagagaaagagagactcacggttacacaatgcatggtaatgtagaaaagcttcagagagccctgtgtgggctggcaatgacagcactaaagccttgaataaaattgcattttatcgtctctgagaagcaaccaaaagtgaggaacaacgacttaaaattaaatttagaccagaatatgtttacctctgtaatttaagcaattttctttgctttgttattcttaaaaatgatgatcttcaaattcaaagagtcattctgtcctggctagtgtcgagagaggtatgtgattgtgatctggctctggggttaagttacagaaattacagttagataaaagattggtaagcttgcaaagcagtgattttttaaccaaggcttccaatcagagttacatgtggagcatttagaaatattcatgcagtttcctcgtccaaggagctgatgtggtagatctaggacagggcacaataatcagtgtttttaaaaattcctcggttgattttcttgtgcactgtcacatctttagataagaccactgtggggaaagactgtttgtcctagggactgaccctggaactatttcctgaaatccacctgtgggtatatcatcattctttgctaggtatctgctattctctagtacgctagagtattagtttcctcgggctgctgaaacaaattaccacaaacttggtgtcttaaaaacagaaatgcattctcacaattgcagaggccagaggtctgaaatcaagaggtcaacagggctttttaccctctggagggttcaggggaaaagtctcttcctcgcctcttctaacctctggtggtcgccagcattctttgacttacgtgtgtattactctaatttccatattcctcttcatgttgccttcttttctttcttaaatctccgtctgccttctataaagacacttgtgattgcatttagagcccacccacgtacgttccccatctcaagttctttaacttaatcacatctttaaagtttttgccatataaggtaacattcacaagttctagagattgggacctggacattaggggtgccattcttcagccttccacagtgagttatcgcttcactgtatgtattcatatgggctgccctgtcccattaaggtccatgtggtaactttctccacttagctctaactaccagtccatagcaatgtttctccccaaaccctgccctcttgcagctaggccagataacccctcacatagctggagataagttgtttttctgagccatagactatgcctccagttttagccattctcatgacaaatgcctttggtcctaaatggactaagagtataggatcagtgcagccagcccatcatcctcaccaacaaaggcgcttcaagcatgtgtcctagcaacggtggctctttaaagctcatcttttaagaatagaacattaccagattatttgaatatattctaagagaggcacaagtcttattatcttttcaaatgggctctgactttggccaggcatatacgatgctataaggtttggtcttaggaggagacaatgtacttagttgatgtaaacatgaagtgttatttacttgagtcagtgtttgtgaaaaacaagttatggaatgtggagagaagttaattaacatgggatttcatttcctcatccgtataaggaaacctttgtttcatgatctctgagttcagttctgaaatcccattttgttggttcttcccttaccatcagaaaggagaaataggtgctagtgcagatgcattttagaggagatggcgagaggctcatgaatgaagaccctgctgaagtttgagttgatgaatattcaatggcattaatttgttctattgtttaattttctctagtagtgctgaattagtcacatacaaataggggaggctgcgaagttcaggaggattattagtggctaggtcagtgctgcccttcattaatacccacctccccacaaccccctagtccccttggcttcagagatgggccgagtcatagaactttctcctagccacgcagatctgtccatgggaaggataggtgaactgaacctctactgggaactttcatactggagctgggagaaataactagtttgttgttgttactattgagagagacaagctgtgaaaaggtgttgcttgttttggatgtgtttcttgtgtagtggagaaacaaggactgcagatggttggggtagaaagaggcgaattgagatgagagagaaattcctggatccctgaggctactagagcatactttttatgatctgactacattaattattaggcctccttacccttaaggtagtgtttaggtatttgacatttgaaagtaaaagaaatcttaactaatctgtaggattttcatacggagaaatcagagtaggattgatcaagagttatataggtgtaaccacagctacttagaaggctaaggcaagaggatcccttgagcccaggattttgaggctgcagtgagctatgactgcaccactgtactccagcccgggtgaccaagcaagaccctgtctcaaaaaaaaaaaaaaaagaattatatagtatctattaatattttcatgtacaacagcagaacaaagaaatcgaagatactaactagactggtggaggtgagagactatgacgtctaggctacacgggaaaggaagtaatgactgccaggttagagataaagaagaatcaagggaattcatttcttaactaggctgagtagataaaaagatgggaagttgtgttgagagtgtatttaagttttggatgcatttgtaaagcgtcttccttttattaagaaaaataataattgtgataaagcactacaaagaacaaggaaaattctttgcaattttgcaattgaaaagaatagggatgacacccactgtctggattcggcatgctacaaaaaaaattctattctatgttgtttacacagtgagaggacttgacctgcaatactgcaagtctgtggaattcggcaagatgatttataatagattatcttcatgagatatctggctgattgaatagcaagaatttttaaatttacaattctacttctctttgaacaaaatattcttgagggaaaaagtatttgaaaaaatttgtgctagaacagaaatgaatgtattagaaaaattttagctgtttagcggtcatttaaactttctacctttatgaacagattttttaaaaatctttgccacattttgaattactctgggtaatattgagtatgatagtagcatctaaagaacctttaatgatctgtctcttttcatttgtagtttctcagcccactgttacttgtgggttcaaaatggctcatgcaagtaatataattcatttaaaaggcgtttatccaacgaaagccctcctgagacttgagccagttttcaactctctctgcacttccataggtgttcagcctcctgatacattaactatatcatagattggatctcttcagtaatcctgagttcttcaaaacaaatatgcaatttatagcatagtctttgtgcctcagtatactccgtattttaattgtacgttctatcccttttgtgtttgagaatacctatcatgtcctgaaaaatataaaatgtgacctggtttttattagctactgtaatatttcaatagttgaattgactatgaagccacaattgagaactttcatgaagtttgtcaagatactggctaagaatacacgtattgagtcgtaaataatataaattctacaacttaaataaatttgtactgaatttggaagtattttgctgaaaagtgaatttactattggtgtgcattgtttgcttacacacatgtaaacacttgaatgagacaatgttaagggcgaaaggatagaaatacaaggcagttctgctctgctgtgctgcttggacaactttctgaacctgccttttcttgtttgaaagacaagaggttagatgacatgtgatcccccttttttctatctcagagtaaatgaagtcttggctaagccttcaagttctaattgatccaagtcattctttgaggaaaaatgttccaacatcatcataatattgttatgcataccgttcttttgttaaatataatttgctcttgtggttttgtaccttagaaatgcatttgtgtgttccttataacatcttacttaaaattcaaaggtaaagccagacactgtggcatatgcctgtagtcccagctgttcaggaagctgaggcaggagaatcacttgagccctggagtttgaggctgttgtgcactattatcatggtcatgaatagtcgctgcactgcagcctgggaaacacagcaagaccctgtgtcttaaaaaaatgtttctcggtagttggtatagtggaacaagctgactacaaggacctttgtaatgctagagctgggagaatcagggtagcagtcttgtgctgactttaccattattgttaccaagggtctaaagaagttttttatccaatctgccacaaccacacacacccaaaatgtaatacttaactgtaaggcagaattgggatgttacatttataataaaaactggattaagtcagtggtatcgaaactctaaaactatcctaagatgcttttccatgtctggcttcagtccccctaccaagtatcttactctttaatttgccatgaaaacaattctatttctttcattaacgaaaaaaaaaaagcagccagacacagtggctcatgcctctaatcccagcactttgggaggctgaggcaggtggatcacctgagatcaggagttcaagaccagtctggccaacatggtgaaaccccgtctctactaaaaatacaaaaattagccaggtgtggtggcacacgcctgtaatcccagctactcgggaggctgaagcaagagaatcacttgaacccaggaggcagaggttgcagtgagccaagattgtgccgttgcactccagcctgggcaatggagtgagactccgtctgaaaaaaagaagaaaagaaaaaagtatgagtactccactgtccaactgagtgaaactacaagaccatattttcaatatgagaaatagcatgcacagtgtaattttaatcacatcctaatattttactataatgaaatgtagtacagtactgtgccttattgataaaagacagttataactttgtgaaagtttctttgtttcatgaaacgttcgttgttcacccaatgctcatttgcctccccatgtattcttcacctttctaaaagcaaggtgactgacaaggggggcttcgtgcctatccttttatgaaggaattacttggtcatttgctgaattcaaaatgtggaacagaatggaaagaataatgtgatctcattttctctctttacaggctctgtacaactcaatcaagaatgagaagcttgaatgggcagtgtaagtgtgctggacgtcagccttttaataatgaactactcacttttttcctactgtctttatgccttggaagtgatcttagagaaggattaaatatgcattgccaattctcattttacaccaagtgtcttacctactttgtggctttatacaagtaaacccagatacaagtaaaacctatttcggttttatacaagtaaacccagagtatcctgtggttttttggtactcagtgtgttcctattctgcttttaaaatggttgctgtacctgtaggtaattaattgtcttttaatttttttttttttttttttgaggtggagtctggctttgtcgcccaggctggagtgcagtggcgcaatctcggctcactgcaagctccgcctcccgggttcacgccattctcctgcctcagcctcccgagtagctgggactacaggcgcccaccaccactcccagctaattttttttttttgcatttttagtagagacggggtttcacagtgttagccaggatggtctcgatctcctgacctcgtgatccacctgcctcggcctcccaaagttctgggattacaggagtgagcgaccacgcccggccttaaatttatcttttaaaaagtaacattctaaaagaaaaatctgctgatgaatagtgtgtattgcaaaatgtaatacaaatggttttggtatcatccacttattttaattatctccttcctatcatcatagatcatggctttccaggtttatttcctatgatactaatcatactaggacactgatagatactaagcacaaaacaacaacagcaaccaaaaaaaggttctctgaatggaataagcttgggagatgatggattgaataaagctattttatttaaacttcagaacttctaggagcttatccaatgccaatgtgtgttatcagtccccaagagaggaatagaatgtgtaatgtttcctgactctctttgacagtgacatatagtgtttcagggtacatactttgagaaatactattaaagatgagctacacctaggtctacgtagaacaataccactgttgttaaaatttccctaatcaatatagcagttcaaaattttaatttttataaaattattatggaagaatatgaaatttttaatcacattaccaggaaattaggtcaaaatgtgttctttgtaattagaacttcgtggattttattttttatttttactaagtattcataagtattgttttaccacgtgacctaacagagcattctacaatgaactcgggtttacagaatcataacttgggagataaaacttgttatgttatctgcacgttggaggaacatgggttaatagttgactgtgtattacatataatgtgcaggaatttatttttgaagtatcagcaccacttgaattgcgtctactcactgtagagtcatggtcctattgcaagttagggagtcaaaagttaagactttaatatttgcatatatatatatatggcttatgtgtctgtatgtatattcatgatgagactcatttaaaggcagcgtgccatttcaaggaaaactgatcattaagaattcatggtctgctatcaaaggtgatcattcttctttaggcttatttctcatgaacaaaagtgggtttcataggaaaattttgtgaaggatatagtcagaatcttgctgaaatgcaaaaaggacatcctgacatatgcagaatatgtagtctagagaaaataaataaaaatggcatcatcatattcactctgggcaagagaatacattgaagattcttttatgaagttattttaaaaaacaaatacatatactcttgaggacctgttttgtaaatctaggtttttttttttaatttgttacagcagattttatttattcatttataggtagtcggagtttgatgcaagaaagctatatcttgcgtgttacccaagggtggaggggcgggagtttacccagtaactggtttcttcttgtgaagttagcagagcatcttgttcagaagcctggatttcagagtcagataaattttggtgtgaattacagctttttcatgtagtagctggttcactgaccaagttaacctgtagtcctcagtttcctcttttgcaagactgagcaaatattgagtctcatgtaaccttcaggatgacactgaaatgtttgaaaacactgaacataaagcaagttgctcttcaattgatgcctgatgctgtagctttcaaagctccaatttctttttttttttgtctttttttctttttctctcttgttcatatgcatatacatagactacatttttatacattgtcaagaattagaagaagacactatagtggttatcgtataatttctatcttcacctataaaatgaaggaattggatgaaatgatcacaagtattttttctagttctaatattctgtaaatttctgagttttgccatatttcagtgtttcctcctgtggaagaagtactgctctatcaagcagatataaaacaaagggattatgggtcaactaagtcttggaatgaatgctagctcaaacaaaattaaacagatctctctgttatcatcctgttcaatcaacgtacatcttgaatttctgcaggagaaatttgaatttaaaaacctgatgtacatcttgaatttctgtaggaaataaatggccaataccccaatttattaaatcactgaatcttatttttgtcttaaagcaccttttaacatctactaaaactggtgctttttatttagaacacacttctgagaacactgacatctatcagtgtatgtgatcctttagcaaaggagctaagcagctgggcacggtcgctgacacctgtaatcccaacactttgggaggctgaggagcctggatcacttgaggtcaggagttcgagaccagcctggccaacatggtgaaacctcatctctactaaaaatacaaaaattagctgggcgtggtggcgtgcacttgtaatcccagctactcaggaggctgaggcgggagaattgcttgaacccaagaaacagaggttgcagtgagctgagattgtgccactataccccagcctgggtgacagagtgagacttggtctcaaaaaaaaaaaaaaaaaaaaaactaagctttttccttgataaaagtgtatgtacatggatataattatttataacactgtgctctcccgtttctcccatacctctctaactagactttctctgacccattttcctcatattatcccttagcgttagatggacactttgaattgtcttcttccaatgtagtctcctcctcagcaattgcaattcactcttaaaacttcttctgccatttctgtaaaaattcttcctatatatatatacagctctgacctctttcccaagtttcaattcagtgtttgcattttcctgcaggatgtttctgctggcacttagcgctcatcgtctgtctccaaacttgtcgtgtgtgctccatttctattaatgacaccagcgtttccggcttacctggattttagcctttacatcatctttgacaccctcccacaccaccacttcgaacccctgcagaaatggctccaaacagcatctttcctcttcactcctgccattcttttgtttttcaggcatttatagtgtttgcctcctcaacaaggccttctgtctccaatcttccctgtactttaacctctgtgaagttcctatgtgctgtaaaactttaattaggcccttcacgttctgccaataattgattttgttctccattcagtgttcgtgaagtcacctctgctaggaacctgtatcccataatcattttatgttcaaagcctatcatccttcacagtccagctcctattccatctgttttcttgaagttttttctgatcttgctaaccagaagtatgatctcagccttaagcttccattttactttatctgatgacaccagcagtttctacaccccattatggttatttgtagtaatgtgccattagattgtaagctctttaaggaaatgatacatgtctggatttgtccctttatctcctctgttgctgatcatagtgtttatatgtaatgaaggctccataaaaggctatagaaaggatgttaatggtaatgaaggaaccacatttcttaaaagataagcctacaatgtgtagtttagaaaatagttacaggaaaggtggtgatgctacaaagtttgtaggataatgcatggaagacttgcgcaggaggcatcttgatgtggatgttagaaccttagaggaaatcacgatagaattattgagtgttagaaccggagaatgttataactgttataaaccttataggtttttatatcattggttttctgactgggttcagtgtaaccttgggttacagggagatgccttggggccttacctgggagtgtgactgaaaattgttggggacccagttctgcttccttaagtattatgcctagttcagctgatcaaaacagctccacttttatctcttttgaatatatgtatagggttctatttcatatttttaaggtatatgttcttgaaaaattttttgaaaggtacttacgtagtccattgttgttactttatatatgaggaaaattaagtcaagaagtgttcatcaataggtccaagtccagtatggtgggaaggccaggattttccccagctgttatggcctcctatggcaccaccatgctgcctggcatctctgtagccaccccgtcttataaagtctttgaagagcagagagtgagtctgaatgtttctgtgctagcctttgatacagtgcacattaagagaatgttgtattaatttgctagtctcattaaatgctcatagaattactagagtttttccttaagttagtagcaaggatcatttatttattcatctattctgcaatctctatccagcttctcctgtgcctggcccagtgctgtgccctagatacaaatatgaataagacacagatccttgcctaatgagaacacaacatgagatttaggggagagggaggactgtacaaagataaaaatacaaaaactgtaatgaagagtgcagtgagtcaaattgacttgtggaaggtctctgctacgtcatataggaccatgaccatttgcctttccaagttcctttgctcaattgttcattattagtgaagcatctatttgttgacctacttgcatcatgcagcctgctgataatttggggagaacaaaactatataaggcattgaggcatttttcttggctttaaaaaatttccagtctaagtgataaacaaagtgagtaattactctttgtgattgggatggcgtaggatgaggtgagttgaggtggatatgggagtttatatcttatgttggaattgtttaaaatgtatctgcatgaggatcttcagaaaatacaacgattaacacaaataggaaaataaaataagttcagtattgtctattaggaaaattaatgttcctctctttcatcctttgactttcatgtttattgctgctttctacaacagtgtttacaaattgtaagaaatctccctgttttagtctgttcttgcactgctacaaagcaatacttaagactgggtaatttgtaaacaaaagaggtttaattggctcacagtcttcaggccgtacaggaagtatgatgctagcatctgctcagcttctggggaagcctcaggaaactttcagtcatgacaggaggcaaagagggagtcagcacttcacatggccagagcagggtggggtggaagtgccacacttttaaacaaccagatctcacaataacttactcactaccatgagaacagcaccaaagggggaaatcttcccccatgatccaatcacttaccgccagatcccacctccaacagtggggattacaattcaacattagatttgtgtgggagcacagatccaaaccatatcattccatccctggcgcctctaaaatctcatgtccttctcacattgcaaaatacagtcatgccttcccaacagtccctcaaagtcttaactcatttcagccttaactcactcttatctgagacaagcctagtcccttgtgcctatgagcctgtaaaattaaaaacaaattagttgctcccaagatacaatgggggtacaggcattggctaaatactcctattccaaaaggaagaaagcagccaaaagaaaggggctacaggcactgtgcaagtccgaaaccccggcaggacagtcattaaatcttaaagctccaataataacctgctttgactccatttcttatattcagggcacactggtgtgaggagtgggctcccaaggccttgggcagctctgcccctgtggcttttccagagttcagtccctgcggttgctctcatgggctggcgttgagtgcctatggcttttccaggtgcagggtgcaaactgctgggggctctaccattctggggtttggaggatggtagccctcttctcacagctccactaagcagtgacccattggggactctttgttggggcaccaaccccacatttctcttctgcactcccctagtaaaggttctccaagagggttccacccctgccgcagatgtctgcctggatatccaggcttttccatacattctctgacatctaggcaaaggctccgaagccttaactcttgcattctgcatacccataggcttaacgccatgtggaagccaccaaggcttatggcttacactctctggagtgacagcttgagctgtaccttggcccttttagccacagctgtagctagagtggctgggatgcagggagcagtatagggcagtgaaacttcccggggactggcctatgaaaccattcttctctcctaagcctccaggcctgtgataggaggggctgctgcaaaggtctctgaaatgcctttgaggcattttccccattttcttgctatcagcacttgcctgccttttagtaaagcaaatttcttcagcctgctgcaaattttcacatggccaggctgcaaattttccaaacttttagatataagttccagttttatgtcatttatttgctcgcacatataagcataggttgttagaagcagccaggttacttctttaatgctttgctgcttagaaatttcttctgccagataccctaaatcatcactctcaagttcaaaattccacagatccctagggcaggggcacagtgcctccaagttctttgcttccgcataacaaacataacctttgctttagttcccaataagttcctcattgccatctgatacctccacagcctggactttattgtccgtatcactatcagcattttggtcacaacaatttaagaagcctctaggaagtctcaaactttccctcatcttcctgtcatcttctgagccatccacactcttccaacctctgcccattacccagttcccaaagttgctgctacattttcaggtattttttatagcaattccccacttcttgggacccatttttctgaattcgtttattctggcactgccataaaggatacctgagactgggtaatttatataaaaagaagtttaattggctgatggttctgcaggctacacaggaagcgtggtgctggcatctgctcagcttctggggaggcctcgggaaactttaaatcacagcagaaagtgaagggggagctggcacttcacatggccggagcaagaggaagagagagagggggcaggtgccccacacctttaaacaaccagatctcatgatgacttaactcactcactcactatcatgagaacagtactaaagggggtaatgccattatgatcgagtcacctctcaccaggccccacattcaacatttgggattacaatccagcatgaaatttgagcggggacacagatccaaaccaaatcactcccttatcctagtttaaaaaaaaaaaaaaatcatgtattggctcattttaataaagtcagccaaaaaaaaaaaaaaaacagttttaaataatgaacttctggattccctctgcacttgtgcaccctccatgttttagttacagcagcattggccttgctttgtcatttagcacatttgttctttttaactctggataagcattttacaactttgcatcgtggaataatctttcctgcaatttcatattgccctacaactcattttataacaataacagtttaaaacatttgctgtatttgctaataagttaaactatttcccatctgccctcacatattaaattgttctggctaattaggtgaggtggtagcacattgatatctttctgtccttccagtcatgtgttatgatagccctgagctttagaaagtgtggttttaaataccaacagtttgtagtttggcttttcatttccttgttgcaaatttaagtcatgactggtcttttcaggaaatcagtgctgcctctttgttggctgatttgctgaaattaggaagtagagaaaattttgcaaagatttcctcccacttctttgccattatgtttaacactgcccatgaaggtgtgagtgtgtgcatgtacatctctgtgtgtattcttgggggatgatagaggcaatgggattactattacctgttttttatgtgggtaccttgattgttcattcaacccaatggcctaaatatgaaattggtaactagttccaaagtctctttgttttgtgaactcttaagaaaactctttttccgagtaaagaagccttctagggctcttttactttcattatttggttcccttatcatattttacttaactcagcattgattctcatttcattttaggtattaatacatattaattaaaatgtaatctcagttgtttctctgtgagagttggtaatctcataaggacgaatagttttcttttcacccaagagtttttctattagtttagactgatttagttgtaccaccttacactttttaatataatttgtcgcctttcatttaagtttttcattttttttgttgtagtgcttcattttgtttatttgccaacattagaatcagccatgaagaaaagttggaatcccttgtgtgtactttttagaattgaacttacatcctaatgaaaagagttcttcctaattttagttaaaatattttttaccttgacataaaattatttggttttctttcaaaaaggcaactcatggtaatttcctttttttgcaatgacttactacattaaataactgtatatccttaatccctagtgaatatagatatataaaattgttaatcagagtagtgtttcttaatagtagatgtagattaatgaaggaaaactttcttgctcgaaaaagttatttgggatgaagacatttatgagggaactttaaaatgaaagtaattttcattttaaacttcaatgtagccatctgtaggttggcaatcattactaacaagaaaactaaggcaagaagaagttgctattgtgcctcttgaaatactagaataacattctcagtgtcattgctgtctatgggactatactcacattcctaaccagcagaaactacatcatactggactcttggtaaaatattaagctggacaatggtatagataaaacatatattttaaatatataaccaaaaatttaatttgagtgtgtgcagagagaggtagggagcttggcatttagggtcataggtagagacaactcaccatggaaaaactgataaaattatttgcacgagatatttgactacaaagaaggaataatgcattcatttattgttgggagaaacagaaggaataaaactcagttctccacttgaggtgctcatacaattaaatgacttttctagatactcattacacctcattgaaattctagaatgagatttagtgttctcattgtcattgctctctgtttcactgtactcaaattcctaacatggcagatactgtgtcacgctggactcttggtaaaataataatgctaatgttagtactagcataacaaacttacaagacaatctatacgaagaataactaaggttaaatctatatatgtatagtggttatgtaaaggatattattggtttgattgttctatttatattcagcaaagacaccctgactgtaagaaaagaaacagaaatgccatagttatgaaaaattgaccattaacttgaaggaaatattgaactaaagagttgagaccacttaattttgttagctattgattattagagttttctacagtaaagtatttttaaattaaaaaattgttagctaaaaatgatattgaacatgaattaatcttctggattttggtatttaaaggaaaaagattttcagtggttagaattaaggaagactcttgctatggtgtcagcatgtccccagagttcatgtgctagaaacttaatccccaatgcagtgttaggaggtaacacctaattagagactgttaggtcataagggaaaagggctctgccctaattaatggattaatgttatcaagggagtgggttagttatcgtgagagtagttttgttttaaaagcaactgtgatccccaactcgctctcttgcgctttcttgaccttctgccttactaggagaagggcagcaaagcacaagagagcaggtgggggttagagaagaccccagcaaggaggccctcatcagatgcaggccccttacttgactttgaacttccagcctccaatactgtaagaaataaatctctgttcattttaaattatgcagtttgtggaattctttcacagcaacccaaaacagactacgacagaagattggtaccgagaattagggctgttgctataacaataagctgaaaatgtggaaggggccttggaattgggtaatccacagaagctgggacagttatgaagtgaatgctagaaaaagcctagactgctgcaaacggagcattgtgggcagttgggtgagggctcaggagaagacaagaaatttaaggaccatctgggacttcttagacattacttaagtgatcataattagaatgttagtagaaacatgcatagtaaagtccattttgatgaggtctcaggtagaaatgaagaacaaggtatttgaaactggagtaaagactgtccttgtaataaagtcacagagaacttggctgaattgtattcttgtccaagggctttagggaaggcagaatttatgagcaaggagctaagatatctggtgcaataaatttcaaagcaaaatgttgatggagctaagtagctacttttaaccacatacagtaagatatgagaggaatgacttaaagatagaacgataattaaaggagaagcagaagaaagattttgaaaatgttcagcctggccttacaaagaatgataaagcatgcttgggaaagcaaaccacagttgtggccaagcaaccatttgcaaagatattgttatggatacaagagatcaagacaatgggagaatgacccctgaaaacatttcagagatctttgaggctgcccattccatcacagtcccagaggtgtaggagggcagaatggtttcaagggatgggcccagggtgctctccaccagagccccctcagttctctgctccccacattctggcacagcattccttggctaccccagccgtggtgtaagccggcctagctacagcttagcccactgttctaggaaatacaagccataaaccttagcagcatccatgtggtgctaattctgcaggcacacagaatgtaagagctgtagaggcatggctttctttacctagatttcaaaagatgtgggatattccatgacagctgctgggtcgtctaagcccagtgaagtcataggattggggctgcctgaggccttgggggcccaaccccaattccagtgttttcaggatttgggacatcaaaggaaactattctccagctttaagtcttaatgttgttttccctatttggttttggagttgggttttgttcattcttttttcttgcctatttctcccttttggaatgggagcatctatgtctgtctcaccatagtatttgaagtagataacttgtttgatttcacaggcccacagctggtgggaaatttgcctaaggatgaatcatgcctcaaattgacctgtatctgatttaggtcagagtttggacttcggacttctgagttggtgctagaaagagttaaaactggggtcactgtgatgaaatgaatgtatttcagaggccacagacagaatactatggtttgaatatgtcccccaaccattaggcaaggcttcataagaggtgcttaggtcatgagggctatgagtggattaaggttgttactgcaggagtgggtttcttataaaaccaagttcacagccctcttcctctctcacactttcttgcccttgcaccttccacaatgggatgatgtagcaagggagtccctcatcagattcaggacccttgactttggacttcccagtctccagaactgtaagaaataagtcaccattcgtgataaactcctcagccagtggaattctgttttagcaacacaaaatggactaggacagctctctcatatggctctgtgaaatgtaattttatcaagaacctaaagcatatctcatacttaatctgagctcacacttaagatttaagtacttgttttctcagctgaactcaggtgtataggaaactggaaagatttgccacccagttcttagctttaaaaggccaaatttttttaaaaaatgacaatacattgtttgcttcatgtctaagtggcatttctcttgataatgagattgagatggatacttagaaattttaagggttttattgtgaaaagcttaaatatttctaaatatgatgaaagttatgtactttacaaatattgttatcttcatttcacattatcttcagaatattcagagcagacaggttggtgagcagatggaatgtgattatgttagtagcctacttgtcctaaagcatttttagaatcactgaggagcaaagaattatggaggctgggatgtaaagaaagcatttttcttagtatgctaaggatagagaatcttatatcctctatatcaattgctaagtgcttgatgtttgatgaggaatgatacaagatgatatataataaatatagtttctgaatgatttttaatgtgtatatgaggagcattttagacagtagttgtttcattgagcatttatgtactcgtacattataatttatacatatatgtatattttttaaaggtgagaaaatttagccagatcaagaatactcaaggaagttatttttagttgccccttaaaaattttccaatagatcttttgggaatacctaacatgtggcttgaccccagtgtattttcagaaacttttttaaccattggttaagtttgtcttggtttggaaagcatactacagtcattgtacatatggtcagatcctttatttagaaagccaagttactagcctacatctttctcatatctggcagcatttttcttggtattaaaaggctagtgatgaagcctaacatttttaataaagcatagtctcttttttacttttaggattcctgtgtcaaaataaggtatttttagagaatagaatgcaattcatattttcagcagaattttaaaatttaactacatgctttcttttttatttttggtaagtgacaaagatccattttagactcatcctgcctcgtggtataatgtgatgtggtataatagaaaccccatgataactcagcacattttttataagttcattcttcgctttattttcctgcaatcatctgatcacagtattgagatgtgagccaccttagtgttctgcccctgcattcaaccaccacctttattttttaaactgctttattgaggtgtaatttttatgccataaaattcacccacttaagtgtaccaattttatgctacaccaatgtttgtaactttgcacacttgtgtaacaaccaccgtagtttatcaccccatttccatcacccaacaaggatttcttgcattataatttagcatgtttgatacagactcttccctcctctctgatcctgtactgctttgtacacagctctgtggagacatatagtattttataaaaaatgttttagccaatattttgtgtatctgtttcccctactggatgatgaacccctcgaggggtcttaatcatcatgatatcaggactgcctagcacacactgcctggcaacttagagctccttcccatcactactcagctggccctgatgcccagggataccagttcccaagcattgcttcctggaggagagcagggacttggtaacatctagcttctaggctggttgtaaggtgaggaaattaaattacagggatcatggtaatgattgccagtacaaggtggactttgggacctgatttataacccctacccttctgtaatgttctggctagaggagtgtatacacagagcagagagctgagtgaaatgaagtcaagcctctgctgtgtaatgcagagtgcaaggcacctgcagaaagttatactggagaatgtgactgggacctgagtggccaccaagcctgctgagctccccagcctaaccatattacaggctgtgaaatcagaactaaaggagcagaggtgagctctgccccactgggtttgccacatagtaaggcaaaagggatagagcggtttacctgatgccaaagaagtagtgggggcaagtgtcgagtttctcttttgagacactcaaaggtaggtcagtggggctaattagttctgcttcctaaatagagaggaaagaacagggctttcttctgccatcttccctccagtcttactgatgtattagtccattctcatgctgctataaagaactgcccaagactgggtaatttataaaggaaagaggtttaattgactcacagttccgcagaggtgggaaggcctcaggaaacttacagttatggcagaaggggaaggaaacacgtccttcttcacatggtggcaggaaggagaagaatgagagccaagtgaaggtgaagggccttataaaaccatcagatctcacgagaacttaatatcacacgagtagcctgggggaaactgctcccatgattcagttacctcccactggtccctcccatgacacatggggattacaggaactacaattcaagatgaaatttgggtggggacacagccaaaccgtatcacttaacaatgtatgcagttttgttgttgtggagggtttgcatggtaaaacttggggtacctgctccatatcttaggggagaggctttttgcagtatttagcctacacttagcagcataggtttccatttagggtcaatgctgtggagacacatggaatatcctgatcttttgttgtggttttgtattggtctatatcaacggagttctacaatcatgaaatactagaactagaatggattcacgaccacagtctgcttccaagagctgttttttgaaagtgaatggggattccagagacctttctactcatcctgggctcccactccctggacaggctttgcatggcttgtatttactgacttagagcaagcttcaaattttacatatgaggaggctgagatctagagagatgctgcagcttattcaggatcacagtgaagtttatggaagagcaagtactgagacacagttgtcccagtttttcttctctagggcacactcccatctgcaaaagtgataaaattaatctgaagctgtggtgaggtagcatctaagtatatccatttcctttggctgccataacaaaatgccacaaatgggctttaaaaacccagatttattgtctcatggttcttgatcactgagatcaaggtgaaaatagggttgtttcctcctgaaggccatgaccgggagtctcctccatgcctctctcctagcctgtggtagcttcagggtcttccttctgtatgtgtgtgtctgtgtccagatttctttctttaataaggacatcaatattgttagattagggcccactctttaatcatcttatttccaaacaaggtcatattcctaaatgctggaagttagtactttaatttctcttgtggggactgaattaaacccataacactaagactagagcaataaaagggaaatggggcacaatggtggactaggaagctccaggcccttgttttcttagggaaacattccataagcaagtaagaccatctgaaagaacttcacatgtgctctgaaaaccaaagatgtacagcaaccaggcaaactctcaattaaaaaaaaaagccacatttaaaacagtagaaaacttcaaagcaatgttatttgcccttacccgactccctccacagcatggtatagcatagtccttaggaagcagcccaattacttactccctctcttgggatgcaaggaagagagtgggacttgataacaatattctggcctgtctgtaggctgcccatgtgactggtttctattttgcctaaagtagggatcgaagaggggatggtgtcatagtttggatttcagactggcacaagccacggaagggcagtggtcaatgccatggcacctgattctgtagtttcccccattatatattcttgaaaccttttccagaaatccagttgaccttagctacttgggatttttttctgggctttctgtttttataccagtatcatgctgttttgattacagtaactttatattttacagtcaaaaaactatgcctccagctttgattttttgctgaagattgctttggctgtttggagtagtttctagtttcctacaaattttagtattttttctatccctataaaaaatgacattggaatttggttactaggtatattttaacaatattaattcttccagttcattaacatgggatttttttctccattgatttgtgaatttttcaatgttttacggttttcagtacacagatcttcacctccttgcttaaatttattcctacttgtttttttttgtttgtttgtttttaatgcttttggaagtgggattgttttcttaattctttgagtagttagtgtacaaaaatgctactcattttttgtgtgttggttttttaatctaaaactttactgactttagcagttctaacagttgtcagggaggggtagtttttacggtttttctatatataagattatgtcagcatcagagacagtcacttccttttttttttttcttgcctaattgctcagcctaaaactcccaaaactgtgttgaacaaaagtggtgagagtgggcattcttgtcttgttcatggtcttagaggaaaaacattccacctttgactgttgagtatgatgttagctgtgggctgtaacagtactgaatcttttttttttttttttttttgagatggaatctcgctctgtcgcccaggctggagtgcagtggcgtgatcttagctcactgcaacctccacttgccaggttcaagcagttctctgcttcagcctcccaagtagctgggattacaggcacctgccactgcagtgggctaatatttgtatttttagtagagatggggttttaccattttggccagactggtcttgaactcctgaccttgtgatctacctgcctcggcctcccaatgtgctgggattacaggcatgagccaccatgctgggcccagtactgaatcttaatgatgataatagaataatcaatttgaaggacagaaatctttcttccagattgattctgatctatgagagactggcagtactgtatttttatatttttattatggtattggttgtagatacaaatagtttttcattgtaaaaataaaatatagaaactagaaacaactcagtatctttcggtagatgaatagataaacaaactggcacgaccataaaatgaaatggtactttacaatggtagggaacaaactatcgattcacattacaatatggatgaatcttaaatgcattttgccaaatgcaagaaaccattttatatgccattctggaaaaggcagaactatagggatggaagtcagttgccaggaatcgatgggagagaggagttggccaaataacagtgtgagggaatttggggggtgataagactgttccatttggcattgtagtgggtacatgactctatacattatctaaatccttaaatctgaacatcacaagaaatgcattttcaaaaatgcttattttttaagaaaatcagtcaggatatgataaacacaaagtagaattcagactataacgaaggaatgtgtttttcacctaaccattgtgatgagagtgagaaaaaaagagctcacccataactttggaaaacagtgtaagacaaaagaaatgtacacaaacactgtactctagtacataaatttgttcctcacatgggtgtaggctagcaattttggaactcttttatatgtttactgagattgaacaaatcaatatattgcagatcgtgaaagccagttttctcactattgaagatgtacagataagcaagtgggagaaggctggaatgtgctggcttaggtttggtggtgttaatataaattaattgggatggttggatggatacacaaatatagatgtgtgtatacacgtgagtgtacttatatatacagtcatacatcacttcataactgtaatatgttctgagaactgtgtcatcaggcgaattcatcactgtgtgaacatcatgtgtactatatggtatagcctattgctcctaggctataatcctgtatagctcgttactgtgccaaatactataggcagtagtaacacaatggtatttgtatatctaaacagaaaacaaacagtaatcaaaaaatgaacagcaacaaatatggcattaaagattttttgtaaatggtattcctgtttagggcactttaccatgaatggagtttgcagaactggaagttgctctgggtgggtcagtgactgagtgagtgttgaatggatttgaaagcctacgacattactacacagtactgtagactttctaaacactgtacacttaggctacaggaaatttctttttaaaaaccttttcttcaattataaattaacatcagcatactgtaacttttttacttcataaactcgttattttagctttttaactttttggtaataacagcttaaaacacattatacagctgtacaaaaacattatatccttattttataagtgttttcctatttttgaaattttgccttttttacttttaaaaacttttttgttaaaaaaattgttaaaaattagaacacatgggactttatagcctaagagtttaaataataaaaataattagaacacaaatacacacgctggcttagggccacacaagggtcaggatcatcaatatcactgtctttcgcctcatgtattgtcccactggaaggtcttcaggggcgtgcatgaagctgtcatctcctatgataacaaagccttttttattttattttactttaagttctgggatacatgtgcagaacctgcaggtttgttacataggtatacatgtgccacagtggtttgctgcacctatcaaaccattatctaggttttaagccccacgtgcattaggtgtttttcctaatgctctcctccctccccttgccctccaccccacccccaacaggccccagtgtatgatgttcccctccttgtgtccaaatgttctcattgttcaactttcacttatgagtgagaacatgtggtgtttggttttctattcgtgtgttagtttgctgagaatgatggtttccagcttcatccatgtccctgcaaaggacatgaattcattcttttttatgactccatagtattccatagtgtatatgtgccacattttctttatccagtctatcattggtgggcatttgggttggttccaagtctttggtgttgtaaatagtgcaaagccttcttttggaacacctactgaaagacctgcctgaggctgttttacagttaactttttttttaataaatagaagtaggatactctaacactgaaaagcatagtatggtaagtgttagacaatgggattttttttggctgcattataattttacaagacaatggttgtatattgtatgctgtccatcgttgaccacacattgttatatgatacataactgtatctccctagctttgtctattgggaggaccccaaagcaatgagcacacctagccccgagatttgatttctaaatactgttctccagtaagaagaaccaaggctccttggagaagtggttgatttcagggccaggacaaggaaaatttaagatgagcttggcgttctgtggtacctgaaagtaaagaagtcctttagaagatgaggcatgttcacaggacataggagcacaccttattataactcccaatggccaaagctgcaaaaatttaagcaacaaattaaataacaatagtatttgattataacctaaagaataaaacaaatatccatgtgtccatacttacagaagaatttcaattaatgaatgtagaataaatgagggaacctttaaaacaccgtaataataattgttacaagataaagttagtgggtaaaggagaatcacaatatttgcatagttacaagatatctccccaaaaacacttacaaagttaaatagtaactttactgtagaggaacctgtgggacactgccttaaccaagtgatcatggttaattctaacaagtaataaaacttgtatcccctggacctaaagcactgagaaagatgcatcacctatatggaatctttccccaaaaaatgcataacgtctatccagtcatgagaaaacatcagaaaaacctaaactgaggatattctacaagataactgaccaatactgttcaaagtgtcaaggtcataaaggacagggagagactgaggaactgttacagactggaagacgctaaagagacatgacaacagaatgcactgtgggatcatggataggatcctagaatagaaaaaaatggtaaactagtgaaatccaaatgaagccgagtttaattcattgtattaaacttacgttaattttttagttttgaaattttttacgatagttattaatatataagatgttaatattaggagaagctgggcataggggaatcctgtccttcacaaatctaaaattctttcaaaataaaagtaaaatatccatttcttctaagagtccagttttgttttcacttatctcacaattactgataaaataccaaaagagaaaaaaaaggctgtttttctctgattaccgtcattatcaaacacttctggttttgtgatatatttaaaatatattgtggttatttgcaaactgttaatctggctaatatccagcttctataaggaacctaaacaattcaacaagcaaaaaactaaataaccttactaaaaaagtgggcaaaggacatgagcagactgttctcaaaagaagatatacaaatggccaacaaacatgaaaaaatactcggcgtcactaatcatcagagaaatgcaaatcaaaaccacaatgagataccatctgacaccagtcagaatggctgttattaaaaaggcaaaaaaattaacagatgccagtggggctgcagagaaaagggaacacttatacatcattggtgggaatgtaagttagttcagctactgtggaaagcagtttttaagtactttgttagagtacataaaaaagaactaccattcaaatcagcaatcctgttactggttatatacctaaaggaaaacaaatcattccaccaaaaagacacatgcactcataggtttattgcagccctattcacagtagcaaaatcatggaattaacctagatgcccttcaatggtgaactggatagagaaaatatggtacatacacaccgtggaatactatgcaaccatagaaaaaggttgaaatcatgtcctttgcagcggcatggatgcagctgaaggccattattctaagcgaattaatacaggaacagaaaaccaaatactacacattttcacttaaaagtggaagctaaacattgggtacacatggacataaagatgggaacaatagatgttggggactatttttatggcggttgagaaagtagcagctgtcacatgccaaagcactgtgcctggcatccccattctaatccatagtagctttgcctggggttttaatattagggactagcctggttatttgggggatattgtttactattgtccattggactgactctaacacttttgctgttttctgtacacctagttctatgctagaccctgtagaaatacgtaagtcaaaatcataattcctgccaataaactcccacttgtttgaaagaagacaaacatgaaagcattgtaaacggtgaaaagaccaatgactttagggattttatgatcatatcttcattatctgttcatcactaaatctgtggccttgtacatttaaactcactgagtctatttccttatctgtaatagaggatattaatatcagtcttataagatattgccatgatcattaacacctggcacacagaatacatttaacaaatggtgtctgtcattatcatggtggtggttataaaaagtgatacaccattggaatacaatgtagttttttacaataacttacctttttctttgaatattatgataggtgcttgactcagtctttgtgctttctcccttttagagatgatgaagagaaaaaaaagtctccctcagaaagtactgaggagaaagctaacggaacacatccaaagaccatcagtcgtattggaagtactactaacccatttttggacattcctcatgatccaaatgctgctgtgtacaaaagtggattcttggctcggaaaattcatgcagatatggatggaaagaagagtaagtatcatgcgttgtcattttctatttcatttattttatctttatgctcaaaatttaaagggaatttatctgaaagtcaaggatgaaaaaattatgtttatctatagacacattcttgaaattggataaagcctctaaccctaaattaaaaatccaatgtggcacctgctcttctctaagcagaattatagaactttagaaagggagaactcctttcaatttattcattctctatccattcatttatttagtcatggcttcaacaaataatactgactacctgctgtgccagccaccagaaatacagggttgagcaggagggacaaggtttctgtcttcatgaagtttacatttctggtggttgagggaaaggttgaatttgcaacgcatagaaaaattaatggtgtaaggtcccagagacaaaggatggagggagggaattcatatccagtacatatgtggaatgactcgcctttgagaaggtggacaggtgagatgtaggagagcatagtataattagttttgggaaattgaaggagcctaattggatggcttctgatttttctgtgaagtgtgaggcatgattatcttgatcaatgatggtgtttggagtttgagaagaatagagcatgcttatatagttagaataatctttgcagagtgaaatagcaatttgatatacttgaacagagtaagataaggtgacatgtttgctcagaattatctttggggtgaagagatggatagtaccactgtttctatctgtagctggatcctttttcttaatgtgttagcatattctattagcttacatggagagaaacattgcagtggggtggctttgacatggacttagcaatgctgaacaaatttcttaatgttcccaagttctttaagagtgcatccaccatatcttctgtgcaccttatatactagattactagactacttaattttatcccacaacattgtatcagaactcactcatatagttgtgacagcaagtgaatccatcttagcaaaagggcacacctgaagatggattgtcaccaggacgtactctccatttctatctctgcatgattttttgtgtcagcattattctttggaatgaggtcctttatacatggttattagcagtgctatagatcacgtgtttaattttgacaccaaagaggattgttcttcttccctaacttctcatttagtctgttctaggacaggattctgacttgtatcactgagaggatggaatattgtgattgacagcccccacttgcttgcaatgacagtaagaatgagatactggtctcagagaatgggagttcttggcacacaaagcaatagatacccatttgtttctttccagtgtgcagacacacccttcttcatacattgaataatacttttgccaaacattgcagttttccttttacaaccacaaatataccatctctctgtaacatgcctgcccaactgcagcttctgtctccaaggctaagatttgttgatagtgttcattcccctcagtcaggtatggatggcactgaaatctataggctaagtgaaaaatacgaaaataccgttgtcccttaatatctgtaggggattgattccagggcctctgacaggtaccaaaatccaaggacactcaagtccctgatataaaatggcatagtatctgcatataactgatgcatatcctcccatatactttaaactgtctctggattacttataatatctaatactgtgtaaatagttgttatgttgtattctttggggaataatgacaaggaaaaaagtctgtacatattcaatgcagacagaattttagagggaatattttccatccaccgttggttgaatacacagttgcagaacccacagatatggagggttgactgtatctgacatacctcacataaagtactagagaaaaaaaaaagaataatttcaattcaagaaaagtcaaaaaggggaagtataacagctatcacttattcggagtatttactacttcctgctagacaggtatatagcacagttaacccatgtgagcatcttttcattgattcatttcctagcaatggattgacttaattggttagtttattccaaagtcccagattctactgataaaattttccttgtccactgttttcctggacccagtggcccaggaaacctcctctattggaggattctccgggtagaagctcttctccctcagcggcctaatacatatgaatatagatacagaacctgaggattgcttagcagttgagacatcacagacaccttgtaccaggctagaagtttttctgccattgtatctcctttaaagccttagttaactgtcttgagaatttctgattggtcaaggcagttttaagtgtcatggggcttttgtctttgtagcaagttaggaagttcgtcctgctttccaaaggaacctgcctctgcttgtttctatctctgttcctgcctcagaaccaaagggaaaatatatggatgggttaagacgtgcccatctccaggcttctttcctgtcagttgctttatcactggaggacttttaacctctgtttttccatggggctatcaggaggagcgtggaagtttcagctgcctttaattcctcaggctcttcctggatatccccatttcaatttcccaaggtttccaaatcacattaatgttagcagataattcagccttacaatccagaatgtgcatggtttctaataatttacaaaaactaaaattcaccaatttagagtatatagtttgagttttgaaaaatgtatagttatataatcatcaacacaattaaaataaataacatttccattacccagaaaagtttaactgtacttttggcagtaattgcttctcgtattactcccatcctatgacggttatgacagatgattatctgtctttgggccctatacttttgccttttctaaaattgcaataaatggaatcatgggactgctttgtgtttggcttcattcacttagtgttattctttgcagattcatgtatattgttaggtgttgtgtgaattaatagtttctctcttcttattgcttaataagtattccattatttggatatcccacagtttattgattcaccagctgagcattctggttgtttccagttttgaactgttataaataaagcccctatggacattcacatataagtttttgcacgtacatatgttttcatttcttttcagaagttacctaggagtaaaagagtaagattgcttcaccatatgctaaatatatctttaactttttaagaaatttctaaagtttctatatcattttgcatcccttatacctatatatattatgtcttcctgatgatttgacccctttgtcatgaaatgacgtccgacacccctggttatattccttattttggagtctactttgtctaatattaatacagccactttagtttccttcatagtttttgcatgctatacaaattttgtttctaactttttattgttaatttatggttgtgtctttaaaattgctttctattatatggaatattggtgggtctcgctttttattgtaaatcacagtatctgtcttttaattagagtgcctataccatttacatttatagtagttattagtatagttgactttaaatctgccgtcttactgttggtttcttatttattccgtctggtcttttcctttcttgtgtaggattattttttgtgtgtggttctgttttttgtcactattggcctgtttgctgtacttctttaattattttagtgtttgctgcaaggtttacagtgtacatctttaatttgtcacagttcaccttcaaattgtactgcttcatttatggtttgagacccttatagcaagttaattccccttatctcttcctagcctttgtgatgttgtcctatattttaattctatgttctaaaacttaaagtagttcattgttaatatttttgctttaagcagaaaccttttttttacttttacccccacataactgctgtcaggaatttttctcatgttttatcagtgtgaaaatatctttattttcaccttaattttaggaatgtatattcactgggtatagaatcctttggcaggttgtttttcctttcaatacttaaagatgatgtttcatttttccctgccctgcaggatttcagacaaaaaaagtctcctatcattcttatctttgttcctctgcacccaagatggctttttctgctactatgaatgctttcaagatttttctatctctggttttcatcaattttattatgtgatgccttagtgtgattttctttatgttttccttatttggtgtttattggggttcttggattcataggttcatgtttttttcagccattatttcttaaagcctccactcctgttatgggacttgtttgctatatgatactcagtgctatcccaagggtttcctgaagctctttccaatatttttaactctttgtcatttcagtactttatttgatagtttttattcttcatttacttcatttttcatttcataatcagcatgtttatctttgaagttcaacttgggtctattttatatcttccgtttctctccttatcaggttgatgtttttcttcatgtccttgaatatatttattctgtttataattgcttttttaaggttcttctctttgataaccttcctttctgtcgtttctggaactgttgcattattttttttctgctggctttagtcatagttggtttttttttcctttttctttgcattccttgtaatttttgagtgccagacattgtgaattttccatttttcaggtgctacttttagttgtattcatctaaaaaaaacactggattttctcctggtgtgcgggtaagtaacttgcagattaactgaattctttagacgcttgcctttaccctttgttctggtggatccagagcagtctttattctgggacttatttaaatatttccattaataaggcattcttgttcttcttcagcctctttccaatatggcatgtattacacagtctatccactctagctgatgaaaacataaattcttcttagccctgtgtgagcccttgaaattgtccatcccactactttatttttcccatgccttgaattatttcctttcactagtgctaagatcgatgctacagccaagagcagagtatcctctgcaggtcttcagaaccatctgtttttgtaactctcccctctgttttacgcagctctacaaattctagccctctcagcatcactaaactcctttcttatctccgcatcactaaactcctttcttacctcctcaactcagcatgactcacaggctctgtttaggtaccctcttccactgttggaaccgagactctttctctaagcagtaagccagtcttaactcatttgtttctttctcttcagaattataatccaatgttttctgttttgaaatgtctaaaaagttttgttttatatacttacatagactttttaagttattatagtagggcagtttctatagcagttactgtttcttgggcataagcagaactaagctgattcatgatcccttttgttaagaaacgtctttccagttgcttcccgctttaagacctaatatttactgaactatgaaattaataaggaattctaagcattcaagtaaaagcaaacagtttagttatatatttggagatgtagaaaagctttcgtttccttcccgtctaatcctgtctcccccaccaacctcatttgttggattttcaatcatgtctggttgaacaggtttatctaactatttggctgctgctccttcttggaaatctaccagaatgccttaattgtttctgaatgtttttgccttcttcttttgagagatggtcactataaacaaattagagaaatgttttatagtaaggacttacacaacctgctataaaacacatcactttttatttacactacacagaaaaaaatgaaaacaacagtggagctttcctggaataggagctccaaataattctgagaatcctgaatgctgttttttggacacaaaaagtagatacttattttctaaatacttactttgattaagcatggtcactataggtagacctatattacatttgtatgtaaatttaaacctggccaggtgctctgatgacaaatattacaaaaagtgttttataagtgaaaatttgaatcaaagctgcatggaaaggttattttgttttaaatgctgatacacttgtctcaaatggaccatttatttcactcaagatttggtgtcttttttttttaattaactttaaacattcagtttgtcagactgcatccatatttttaaaccttggaggttttcttcattttttgccttttaaagttatgctcagttcagaaattctgcctccaggagacaaattgttgtacctatcttagaagtatgtatttttacaaagacctattaaatctgacattaagggaaagctttgaaaagtcaaatttggaaaacaaaacgcatctcctgggttttgtcagatacaataaaaaacaaaattcagtataagctcttagttttctcaatatgatgtaacatacttgtggaaatcaagaaagaaactggaaacaacatacccaaaatataaatgatctacacaataacaatagtgataattaaatgattgctaaatattagagctttatcctaagcatttcatgcattaatacatttaatcttggtcctataaagcagatattattattgtcctcattttatacatgaagacactgatcctaagcatcttaaccaaggatgtagtatagaatagcagtgtatctggtggaacaaaaatctgattataccaaactaatagtagcatattgttaaaagcaattccgatgagaaaatatgcttatgaaatgtttaaattctgcattttttgtgtagttgggacagtctgtcactgtgtagcatgtatttagataactggaggtctcaagctagggacagtgaagcctgaacatttcttttacttggccaacacagtgctgtttaaacactgaattgcctggatgtaggcattttctggttgaccatagttttcacagctccctgtagccttataccaaacttcctcatacattaagggggagaagtacagtagggccatgttgacattttccaagataataagacatacagataggatgatgggttggaaaagagaacccagaagcagcagtctccagtgtttataaaaatttgatggatgatatagaaagtaagtcagataattagaagcaaaaattcttccgtaatttatgttgagaagtgtgtgtgtgtgtgtgtgtgtgtgtgtgtgtattccccacctcagttctaacacaaaaaccagtttcacgtagattaaagataaaaatttgagaaacaaggttctaagatttttagaagaacatgtgggacagtaacttcatgacttttgggtagaaagtgaattcttaagatttataaaagcagctgggtacagtggctcacacctgtaatcccaatactttgggaatccaagacaggaggatcacttgagcccaggaattcaagaccagcctgggcaacatagcaagacatcatctctacatataaacaggcatacgtatatacatacatatttacaaaaacagtaaaaaaaaattgatatgtataattacactaaaagtaaagactttatattaaaattgtacttaaaaatgaaagataattcacagattaagatacttgtagcatattaccaataaaggattaggatccatggtaatatttataaagaaattttttttttcattattttttcttttattcttttttttttaatactttaagttttagggtacatgtgcacaatgtgcaggttagttacatatgtatacatgtgccatgctggtgtgctgcacccattaactcgtcatttagcattaggtatatctcctaatgctatccctcccccctccccccaccccacaacagtccccagagtgtgatgttccccttcctgtgtccatgtgttctcattgttcaattcccgagaaattttaaattacttataaaaaatacaactcagtagaaaaatgggcaaaaacttgaagaggccatgctcagaaaatgaaactgagatgatcaatacatatatgaagacatattcaaccttattgatattcaaggatattcattaaacatatagtgaaatgtcatttcacatgttaccttgacaaaaattaaaagaataccaagtgttggtaaggatttggagcaatgggccctcttctaccctgcaaaagtattagtggtatcatttgtacttcagaaagcagttggcaataataaagttggaaatgtttattcttatatctcagttaattagtcataagggtgtatacacctataaaaactcttagtgttacagaagtcatgtttatagcaacattataatagctcaaaatttaaaaacttaaatgtccattaataagagattgaatggattttgtatatccatataattgaaaaggaaggagctagagttccacgtatcaacatggaggaatctcaccagtggtaatgttgaatgaaaaaaagcggcttgcagaagaatctgcacgtaagataacatttgaaagcatgcaaaacaatactatttttagtaagaatacattcatatattgaaattattaaacatagaatggttgttacttctggaaaggagaataacaggcagtcactgacaagtacccagtggtttcactatattgataatatatattttttacatttggcggtagtacatgtatacctactttattactcttgataaccttttgaagtcttatatgttttacaattttttttttttttttctgagatggagtctcgctcagtaacccaggctggagtacagtggtacatgcaattgtagctcactgcagcctcagacttctgggctcaggtagtcttcccacctcagccacccagatagctgggactacaggcatataccaccatgcccagctaattttttttttttcctttttcttttttttttttttttttttttggggagacgggggctgactatattgcccagactggtcttgaactcttggcctcaagcagtcctcctgccttggcttcccagagcgctgggattacaggcataagccactgctcctggcctataaataaaatttttaaaactcaatagaacatctgattgcatggaaaatttagaaacatataaggatgtttttcttaaaatctgcacaggaaaattacaattagaaaactcagtaaacaaaaatccgtagcgacagaaaacggtgaccagacacagtggctcacgcctgtaatcccagcattttggaaggccaaggcaggaggaccgtttgaatctaggagttcaagaccagcctggaccatatggttatagctgtctctacaaaaagattttttgaatgaaaattgaaaagaaaaaatgactttgtgatcgccatcattatagcataattaataatttaaaatcttaccatagtaatagaattttggttactcacatttagatatgtgaaagatttaattgtggtacacattaaaatataaatattgtgcaacttgaacctgtaagagtacagatgatagaaggtgggaggtaaaactggatagaactaagagggagcagggagagagatccgttaagctcctcttacagagaggaagtcagaagatgctgcctgtactggagaaagaagaaataatgtcagtcattatttgtcaaattaatacataagaaagtggcaactatgtgaggtgaaaagtatgtcagttagcttccttgtggtaattatttcaccattcatatgtaaaaacatcaaattgtacacttatgtacaatttttattggtcaataacaccttactaaagctggggaaaaaatttttcactaaaataataataatgttatgctccataaaactacagaggtaatcaatacagatacaaataaaagctatgtaagtatattgggaagatggaatggcatagttaagtttgttaaattctcatctagcacagcacaaaactgagagtgtgtttacagcctattatgacacagtggtagaagcacattgtttagggatataatgtcacttaacgactcggagaagtaatttgtttcaaaaggtttttttgtaaaatgggaacagaggaggtgggaagaaatgaatcaaaggaggctaattgtgtggacatatcactttaataattttaaaatattttaatcacattcttttatagattctttagtcattgtacagtcctgagattagttctgaatttgaaatattaaaatattcatcgctttttaaggaggtgagaactatgtgtggttcagcttttcaatctcattgtaaatactgtggatacaaggagtggtgtggagcaccttgacaaggttggagaggttcactcactttagagggatttacacacctgcctgtcatcaaaagtttagaaaatttagtcccacatgtcaaatttaagaaagtagaatttattctgagtcatccatactgaaaatagtttataatggtaatgcaggcagaattctttgctatcgtgtaacattgggaacagcgacactataattaagagataataaaagtggaattttttttcccaaaagacagttgtgtcctcctgttagagcaagactctttaagtacaggcaaagccaagcaattattttaaaactaggctaaggttttcccttcccttggcacttggctgttctctggcagcagggtgtgtaacggagcagtttaagatgttaatacaaggccaaacaacagcactgtgagggcagccatgtgaacgcgcaggagcaccttgtcacgtgactctctagttttaatggaatattggctgttttagataggaaataccccattcacaattcaaaatttagactaaaagattaagttctaggtttttacattccgtaatgatggctcatgtctttaaaatccatgctttctggcaataaagtcggttgaaagaggtcctccgccatcattctcatcaggagcaatagtcttttttctgagacggtgtctcactctgttgcccaggctggagtgcagtggcacgatgtcagctcactgcaacctctgtctccctggttcaagcaattctcctactgtggcctcctgagtaacagggactacaggtgtgtgccaccatgccgggctaatttttgtgtttttagtagagaagcggttttgctgtgttggccaggctggtctcaaattcctgacctcaggtaatctgcccttctcagcctcccgaagtgctgggattgcaggcgtgagccaccgtgcctggctggaagcaatactcttgactaggaacaatggaatataaactgccaatcttatagcaccaaaaaatctgtgttcagaatctctgaagtatttttctgaaagaggaatgttcagttttcactgtgcatgtgatttttagaggttattctattttcactgctgactcgttctgtttatgatttcggtttaattaacatttaggagaaagaagaaaataattcttccatccctgttgtggtaatttaatgcagtgtgtcaaattctttaataatctgatgaaaatttgaaattaaaaataccgtactagtttcctaaaggaattaatcatggggataagaatgtatatgcaaaagatgttatcactaatgttaatggaaatatcaaactctgcaaaatgttttctctttttttcttttgttgagacaggtccttgctcactcacccaggccatagtgcagtggtgtgatctgggctcactgcaacctctgcctcccaggctcaagcagtcccccctacctcagcctattgaatagctgggaccacaggaatgtgctgtcacaccccactaattttttattttttatagagatagggttgcaccatgttgcccaggctggcctcaaactactgggctcaagtgatccaccaggcttggcctcccaaagtgctgggattacaggtgtaagccaccatgcctggccctccaaactccataaaatatcttaaagaggtttattctgagccaatgtgagtgaccacagcctggggaaaaaaaaaaaaaaaaaacacaaacccaagaacccttcagtaagtagtcccgagacagtcaggttacagtttggttttatacattttatggagatgagttacaggcaaagacataaatcagtacatgaaaggtatccattggttcagccccaaaaggtgagcatcttgaaatgggggcttacaagtcataggtgggttttagggatggttgagttattggttgagagagttaagctgttgtctgaggacttgaagagtagacaggaatgcttgagttaaggaggctctgggagccacggcccttatcacgtagaagcagcctcatgggtggcagccctcagagaaacagactataaatgtctcttttcagacttttgaggtgttgggctcttagctaatctctcctacatctgggaaaggcctagaaagggaaggcctggctgcatcaatggcgattctccaaagatgttaatttcccccacaaaggacggctttggagggtcatttcaaaatagttcaaagaaatttattttggggtaaaatattgtgattgctttcagggtctgctgtcatgtgatgctataccagagtcaggttggggagtaagccacgttataccaggttaataaaaatccatttagtgaaattttatggttagggtgtgacttcacctttgcctcacatggccacacggccttaggtcttttttttttttttgagatgaggtttcactcttgttgcccaggctggagtgcagtggcgtgatctcagctcactacaacctctgcctcccgggttcaaaccgttctcctgcctcagcctcccaagtagctgggattacaggcacgcaccaccacacccggctaattttgtatttttagtagaggtgggtcagaccttgttggtcaggctggtctcaaactccttatctcagatgatgcacttgcctcggcctcccaaaatgctgggattacaggcatgagccagcataccccagtggccttaggtcttgtttataatctggtatcttattgccacacagagtctgttttgatcagtcttttgatctgcattttaaccgtaatgctggtcagtcgggcctgaacttgaaaaggaagtggatataaggaggtgcatctgaacttccatcccatcgtggcaggcattcagttttttaggtttcttttggtcaagagggggtccatgcagttggttggagggcttaggattttttatttgtttacactagatagacctaagaatttgagctttgaagcaagatagatcattgatttattttttaaaaaacactttgagctcaagcagtatgccagtaatactcttggtgaggaggagtagagatagaggatatgccttgttactcggctgagaactgaattacaaaaggaagttccgtgatatctttggacacaaaggtcatggataagcgtattccaccacagcctgagcaacatattaagaccccatctctacaaaataaaagaataaaaagttagccaaacatggtagcatacgcccctagacccagctagtcagggggctaaggtgggaggattgcttgagcccaggatgttaagtctgcagtgagccatgattacaccactgcactccgtcttacaaaaatagaaaagaaaagaatatcccattagaaaaaaaaaatgcaaaaaccttaaggtgagagcaatcaaatacggctaatacctgttatggtgtgtagtacactgcctggtacatagaaggaatccagttgttattttagttacaaaataacatcattttagaaacagtttaatggccaataaaatgtttaataagtaaaatatgatagatacagcaatagaatttcatcatttgccatcatttttaaaaatgatattgttgacaaaaaaaagccaaagtctgtaaaatatttgaagaggcttattctgagccagatacaagtgaccatggcccatgacgtagcctcaggatgacctgagaacatgtgcccaaggtggttgggttataacctgtctgtatacatttttgggagaccaaagttataggcaaagacataaatcaacacatataaggcatgcattgattgatttagcccagaagggcaggacacctggaagcaggggcttccaggtcatagacggattgaaagatttcctgattgtcaattgcttgaaagacttaagctttatctgaagagttatagtcagcataaataaatatttgagttaagttgagggggtggtggggtggaagccaaggttcttgttatatagatgaagtctctaaataatagacttcagagggaatagatgtcaaatgtctcttactggaccttaaaagatactagactctccagaaaagatttagcaagggagggagattctctatagaatgcagatttcccccactagagacggctttgcagatcatttcaaaatatgtcaaagaaaatgcattttggggtacaatactttgatttcccttaggacctgctatccatcatgtgatgctatattagagtcaggttgaaattggtatcttagtgctactaagagtctgttttgtcagtgtcgggatctccattttagtgttagtgctggtcagttgtgcctaaactccaaagggaggagggcataatgaggcatgtccaacaccccctttctgtcatgtcctaaactggtttttcaagttcctttggaatccccttcaccaagagtagggttcattcaggcagttgggagcttagaattttattatgggcttacaatgtatgatatataaatataagagttttgtttgtttgtttttgagatggagtttcgctcttgtcacccaggctggagtgcaatggtgcaatctcggctcactgctacctgcgcctcccaagttcaagcgattcaccttcctcagcctcccgagtagctgggattataggcacccaccatcacgaccagctaattttggaatttttagtagagatggggtttcaccatgttggtcaggttggtctcgaaccccttacctcaggtgattcacccacctcagcctcccaaaatggtgggattacaggtatgagcgaccatgcccggccagtagaaaagtttaaaattaacaaatataatatctcagtttgttttgcatgtgtgtacatagtaaaatgattagaaggttctatactgtaggggtcatccaggaaaaaaacttccccatcaccctctgaaggttcactgaaaaatcaactcaccaaagccaggtgaatgagagaaaaggtgtacaaatttattaacatgcacacaggggaaaatcatagattgattacacgaccctcaatggagtagagaaacttttaccttataattgaagttacagaaagaatgggggcttggatcaaaacaggttatgaaaagagaggaagatggccgggcgcggtggctcacgcctgtaatcccagcactttgggaggccgaggcgggcggatcacgaggtcacgagatcgagaccatcccggctaaaacggtgaaaccccgtctctactaaaaatacaaaaaatgagccgggcgtggtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaagaaaagaaaagagaggaagatgaggcctggctagcaaaggtgttcctgttaagtaaatgaaatctcacaagtaggtggtaaaacctaggcatgatgagagcgagaatagatggtgaatgtttctttcagacccttaaagatgtcagacactgagttaatctttcctagatccagacgagggaaggcctcggagaatgcctggccaccatcaatacagattctctccacagatgcaaatctcccccacaaaagatagctttgcagagctacttctgtttgcagggcctctgaaaggccatctcaaaaatatgtcaaagaaatgtattgtagggtcgggtattttggttttcctcagtgaagagcacttgaacgcactggacatctgataaatggaagaaacgtggtctgagttgggaaaagctaagaggccatcgtggagcagcatcacctcaggtgcagtctgtagcagaccgttttctggctcctgcgcgtgagtggtaagccagagccctcgccctgtaatgagggccaggaacacctatcagtaggcaaagcttgaagtcacttttggagctcctaggttggggaaaagcaagtgaggctgttatattccttggagaacagattctgtctggaggctgctcatcagccactttgagttatttttattgaccttcagctgtttttgcccggaggcattttaaagatgcccgtgggccttgggctgttttacaattacaatagcttatttgaattgctagttgtagaaatgcgtgcacagcagggtcttcgctctgtccttccctggcttctggggtgcttcagaggttgaggaaacctgatttgctgtcacttgacaagcccacttgtctgattcagcagttacctgcccttctcagatagactgcgatgatttaaccttacatttattttaacaccctgctcttaaaaggtatgtaaaaaggtctagaaactgctctagatattatgaaaaaaatcatagtatgcttgattttcttgatcaatgttcacacctttcacataaacgaacttatcaaatgttatatataaagtttcagtgctgcaaaagaaaatatcactcaaatataaaattttctttttaattctcagcaagacacgttacttctatatagaagggtgcgcccttacagatggaacaatggtgagcgcatacttggacaagggaggggaaggggttcttatccctgatgcccgtggcccttgctgctgtgtcattcccttattggctagggttagaccgcacaggctaaactaattccgattgactaatttaaagagagtcactgggtgagtgctttggcaggagtcagggcagagcaggttgggggtaattggaatgagttagggtggagcaggtgattggaatgtagggtgcagcaggtgatcagaatgagtcagggtggagtaggtaattggaatgagtcagggtggagtaggtaatcgaaaaaggttgctttacgaggaagttaagtttaaaagtagacggcaaagaattgaacatattgacatattctttgaaaagaaatttagaattcatatctaacattgaatttcaggaaatttttgttatgcctaactttttgaagtgattattaaaaacagcaagttctccagcatattccttcagtcagatatactttatagaattatgaggcctgtgcagtggttcacacctgtaatttcaacacttagggaggctgaggcaggaggatcgcttaagcccagcagttcgagaccagccggggcaacattgcaagaccccgtgtctatgaaaacaaaacaaaaaaaaaattagccaggcatgatggtgcacacctgtagtcccagcttctcaggaagctgaggtgggaggattgcttgagcctggcaattggaggctgcagtgagctgtaatcaccctgtctcaaaagaaaaaaatatgtatatgaaatgtcatttgtttgatagaagtttgaagtcacttgtcacaaatgttcattctttaattaacccatgaaaacccacagtaatgtattaagccttatttgttccttttaagcctgggtgtttactgataccttattcccatattcaatgtcttattggaataatcgaccacagttttattctacctcctcttttctctttaagcatcctgcgttttacctaaaagattaagcactaaaaaaaaaaaaattcccggtaatatttgttgaatgatgccatctacatgctagtttaggacatctgatttttttgggggggggatgggggagaaggggttaatctgctctgtggttgcagcaacaaaccaacgtacttgccttcaaggttttattctaatgctggagaagcttaataaaaactttgtgataagttacacagctgttaactgacccaaagaaaagtaaagtcaaggttaggaaatactgaaggaagcatacacgtcctatgttgcagagagtgattagaggaaaccccaggatgaggcatgtcaactaagaagagatgacaaaccagaccgcaatgcagtaagacaagacatttattgggcccttaggaattataattcaggagacacagatttggctgtaagccaaattgtgttccaaaccaagtgagggtttttcaaaggaaactaaaggattacacaagttgttttgaaggaattatcatgggtggaggcggccggcttagcacaagtccatagttcatttattgttgctgtttaggagttgcagcgctggtgaaattcagctgtttttcaggatatcatggttgtggtggttaggtgcacttcaaagattcaaggcaaggtactgggttgttttgcaaggttgccagtggtgcaggcagccctgagaatggattctgctttagagccctgaactgtagtgatgccgttttctatgtttcacagataacatttgagcagagacctaactgaagtgaaggggccaagtcatggtatctgggagaggaacattctagccatagagaatgtgaggtatcattcattaagattcaaaaaataattctgtgactctagcgttgcaggaaaaaaaacggggttcttgtcacacgaccaggaaagattaggctcgcagacacgtagaagggtgacaagtggaatttattaggcagaaatgaaaaaggaaatacgcatcagcaaagtgagataagagtcctgctaacaggctctccatctcagggattaaatcccaccttaccacacagaaacgagagagaccaggctcctcccccctgcaaacagtgcaaacttcccaaggccccaccccctcctcccaatgtgcagatgggcgttattcagaaagaatcatttggggaaaagggtgggcttcatccggaccggcagtctggtttttcatccctcatgctgttttaggcttgaaggcggcatttcgtcaggtgttgggggcaggaggggtccttggctgcctcctgtctctatcactggtgtttatatttttcctgaaaaaaatgatgtagtgagagtcattttgggatttgttgcttcccacacacgtttccggtaacccttagctaatgatgcatgctcttgtgttctgacctgttttccaacctcagcccaagccatgtaaattcttcctgcacgtctagtaatggctgccagtgaaaccgtctcctggccaagtggggaaagatacttgtttttaagttagatctgagcgactctgtggctcatcttttgggtagaaagttctccaacagcttttgtctcttctattgtctacttttattgtttgcattcatgtttgatatctccaatgtcaatacaggacttgggacaaaatgaaaacaataaatatattaatcggagtaaatgtgtcacacttagctctcttcccagttaagggtggtatgtgctaagtgtttctgttaaaaatgcatcagtaggccgtgtgcggtggctcatgcctgtaatcccagcactttgggaggccgaggcaggcggatcacgaggtcaggagatcaagaccatcctggccaacatagtgaaacccatctctactaaaatacaacaacattatccaggcgggtggcgggcgcctgtagtcccagctattggggaagctgaggcaggggaatggcttgaacccaggaggtggaggttgcagtgagccgagatcacgccgctgctctccagtctggcaacagagcaagactccgtctcaaaagaaaaaaaaaaatgcatcagtaacgttaaagcggtgttctcaaacattgacttacaaaaaaaattccgaatacatgaatgaaatgtcaacctgaagtaactgaaagcatcagaatccaattttagagtttattcaagcaagaatctgggaaacatggactccagagaaatgaggccagtgctctgaagtaaaaacttaaggtcttgcttatatatgggcagaaacaaagaaatttagtaggattgtaacttttttttatgtaaggctgctttgtgggttataataatttagttatttttcttttccgtacagcttgtttttcttctttacagcttgttatcatttacttcacaatttaaaagagttcatttaacattccaccttagacaatgtgatagtcatcatcaagtctttgtgtgagaaaggtaagagggaaattaatctgtaatgaagatcaacagttaagcaagaaggggtcttccctgctgccttttagtcatttgcaacattttacaaaacagtgtagataaggaaaaaggctaatctataatcagacaaacaatcagagaagcaaagcttacagcttcctaggttacagctgcctgttaatgtgatccatccaggtcccttaatcacattcccttaaggctctaataaagttccagcaacttagatttaaattgcttattttcacagcttattttcacagaagtgagaaaaaaagtctttctttgtgttttagcatgaaaatttgatgcattttctttagcagacagtatctttaattaaaaaaaaaatccaaaggattgcatatattaactcatctaagtctcagaaaaactgttttatacaggaagaaagtaaagcataggactggctaagtgacttgtccaaggtcactcaggtgaagccagtatctcaaaccaggttctctggttctaaaatgtgtcctcttaaaaaataaaaaattatgtgttttaactgttgttcttaggctgtcttgctaaaggatgatgatcatttgcaatgttttgagacttccaaaattgggatccacattttgattccatgtcttcctgctaacatactgtacaaaaggtgaaggttaaaagaaaaacctttttttttttttttttccaaaatcctacattaaattacaccctcatttaaagtgttctctaacctctaaatcctattcataagcagaattaatgacctcctccttgttttacctcctggaatccccactgtgattgtcttaggttagtgccatgctaccatttagtttatacagtttatcatgttaaattaactttcattgtttatgttactgcctgtatatgtaaattatttaggggtagggtatgtgtcctaataatcttatgtacccagattaactcaacaacattataaagtaattatggcacatcgtagtagattcattgtatagatttttaaccagagatgtttagattacttgtccaaaagcggagaaatagtgggcatcatggtgtgaataaaatctaagtgcctagctcccagtttatgatactttctggcatttcagaacattttagggtaaaagtcttgagacctcttataggaatagagccacatccagaatgaacagcaccccactagggaacactttgaatagaatattcttccaattctctctttgttttcatttcttattctctatcaaaatatgcattggttgctattatataagaaaaggaaataattttctgggaaaagcaataggtataggttctgttaaaagaaaagcttcagcccaattaaatttaaaggagtttaattgagcaatgaatgattctgaaatcaggcagcccccagaatcacagcagattcagagagattccaaggatgcctcgtggtcagaacaaatttatagacaaacaaagggaagtgacatacagaaatcagcagtgaggtacagaaacaactgggttggttacagctcagcacgtaccttatttgaatacagttcgaacactcagcagtgtatgagtggttgaagtacaaccactgggattggccaagactcaggtattgttacaggtgcatactcctaagttaggttttcaatcttgtctacctattaagttaggttgcagttcatccacaaggactcaaataaagaagtatagagtcctaaggccatatttagtttgctttaacagttcctacaaggctgccctacttttttcctttataaaatagagttgacaaagcatccttttataaaagagaaagactataaggattaagtgattttttttgtaatgtgtaaattgccttaagtgtttcaaagataagtgattaggaatatatagtagtaatagtactgttttagtgctaccacgctgctataaaccagggataattaatactgtcacttgctgaatactggaatactgtgtgactcatagcccagtggtaaattttcctttgctcagcttggacttgattgcttcaagcagtaatctaaaagtgcctgagctgctctattaattaagatgtaatagaatatcttgtgatgcctgaggatattttgtaaaagaaagttagaggttaatatacaggattacccttaacttcacttaatcatctgtgagtctgtcatctatgaacttatttaaattctttgcacatcaattgcagaaagcagactcctccctgcgtgagttgtatcttcaactgtgtcattgattagaacttcagaactcccttcttatcaaggtagcctgtttcttcatgctttaggctacatactttaaggattttgttttaaagatactttaagttgtttagttctatcactgagaaaatagaacagtcttaaaaatgccttgtgctttttacagctagtatagatgatgtctcacttatattagtacagaacttctgctaagtatatctttgttttcaagttcattaaagtgctgggtttattttggaatgccatcattgggattgctttatattgtgaatatctttctccgttaacctcaggaaattcaagatattttgcattagaactacctcatccccacatacctgtttcttggcctggcaggatttgcattgtcggccttcacgccaagactcttggtgaggccctgaaaaataaattacttctcattaatgtgtatatggctaattctctctctctactctgaggggaataaaatggtttttttgtcattttacatggaacaatgggagaatattttcaagacaacagacaggaagtaaagattaatatgttaaatgaaaacaataggcaatgctcatactatgtctttctatccatattatgactttctatccatattatgactttctgatagtaaacatgaggaaaaggaaaaaaaagatgatcagggcacccagagagatgagtggtcaaaaaacaggacaagattttgatgtaggaacaaatgctctgccatttgaatgaaatagaaaattggaacagtaaaatcttaaacacaatccatttccagttcagttgagaagaaaagttggagagtatagcatgcaaatataaacttctgcatgaagcttataccttttggtggattaaaaaaaaacttttctggcataaatccattattactcgttaatgaatattttattgtttagaaatattttatatcttcctctttatgaaagaggggtgatactgtcttttcattccccgttaagcatttcacttttacaaaaatcagtggtaataactaaagccaaaatattattcactgtactttatatttccaaatatgtttcttcaaattagtaataaagagaaaataataactggtttgtaatatttaagattcagtgatggctccaatatcacccatctttggaggaactgccaatttttctattgcagaaatgtggtcttcatgtgtatgtgagtttgactcagaataacgatcacagcagcttgttggtttcattcacttcttaatttcacccatactggtcaggaagcagcccccaagccagagctgatactcagagactgtgtactggtacagaccatttactgtggatgtcccttcaatctgactggaacagtgcttttcccaacagctcaaggtagctcctgaatcaactcttaaataattttttttttgagacaggatctcactttgtcacccaggatagaatccagtggcacgatcatggctcactgcagcctcaacctcctggactgaaacagtcctcctacttcagcctcccaagtagctgggaatataggcatgcatcagcatgcctggtgatatggtttggctgtgtccccacccaaatctcatcctgaattgtagttcccacctggtgggaggtaatttaattgttgggggccattactctcatgctgttctcatgataatgagtgagttctcctgagatctgatggctttataaggggcttttcccctttttgctcggcacttctccttgctgctgctatgtgaagaaggacataatcatttccccttctgccgtgattgtacatttcctgaggcatccccagccatgctgaactgtgagtcagttaaacctcttccctttataaattacccagtcataggtacatctttattagcaatgtgagaatgtactaatacacctgacttcctttttttttttgttttgttttttttttttgtagcagtggagtcttgttatatgctgggattacaggcgtgagccaccgtgcccagcctcagctcttaagtaattttaatatcactcctagatcccagatttatccaagacattgcctcccgaatctagtttagctggcctttctctgtatggaaaccagagtgaaaacgcccagtgctatggagaaacaagtgctgccggttcataggaggtgagaggaaggtggtcataggttccacatctgtgagatggaggttataaccgtggatccctcatagacttacgggcttttgtttatacaggtcaaatcttggaacagtgcctaaaacagtatgtgttcagcaatcatttgctgtgctattactacttctgtaattattagtaatattagataactattctgcagaaatgtggagctgggagcacctgagggggcaggcacagagactgtgcctctgttctgagatctgtagtcatgagcagggatgcctttgaaggtcctatagttgagtgagattagagaaagtacctggttatatttccctcttatctcatcatctctcttcctgccttcagtgcccacctcacaggagtagcagaccgaccactgcaaagaattgtcacctggatattttctatttcttaatgtatctttagaaaatatttacttaattgtcctgtacagtagctttgaaatccttagatgggtagcttccttgggggcatactctacctttcagaattgtaaatatagttaataatgggggcataaaatataaaacagagacaataatacctacctgaaaagattgtttggaacacatagaacgtataggtataacgttagcccaacactcagagtgctgcagtgtaggtgcttagttaatgttaatgcctttccctttccttccattttatcttaatgtatcgtatgcctctattcatgttctggcctttttctcttatctcacctactgtaataatttccttactggttccccttgttccagtttctctccttgttctcactctgcaatatctcctgcatcctgctccaaatgaattcttcctagataacaaagtttgtgcataaattcttcccttcttataaaaagaaggaaagaaaaatgcaatagagaatctattttttgcaatgtgatggcctacagattctgaaactctcccataataaaacatctaaaactgatagatgaaatatttttagataacttttatctgaatggataagcctgtaacaatgaaagggaaatcctgttaggccaggaataaagcatgagtacaaatgtggggaggtggccaaccctggggatgctaagccttcaggacatttttggatctaggtggcctaccagtactgaagataaaattacacagcatttagcacacaagtacagagagatggagaatatgaaagagtgaataagtcacaagtggaatgaagtgagaagttagaatggagtgtcaggttacaatcatgaagatgatagaggagagacattattcaaagttataatgtctacaggtttttcaaaataatacacaggaagctcaaagaacagcagtctgtgtaaattaaagaaacctgtgcttagacatagcatttagactcagggtagaaatctgtagtagtccattctcacactcatctgaagaaatacccgagactggataatttataaagtagtttaattggctcacagatccacaggctatacaggaaacatgatgctggcatctgctcagtgtctgggaaggcctcaggaaacttagaattatggtggaaggtaaagggggagcaccacttcacatggccacaggagaaagagaaggggggtgctccacacttttaaacaaccagatctcatgagcactcattcactatcatgagaacagcaccaaggaggtagtgctaaaccattgatgaatcatgatccaattacctcccaccaggccccacctccaacactgggaattacaatttagcatgagatttgggtggggacacagatctaaaccatatcattccgccccaggcccctcccaaatatcatgtccttctcacatggcaaaatacaatcatgccttcccaacgttccccaaagtcttaactcattccaccattaactcagaaatccaaagtctgaagtgtcatctgagacaaagctagttccttctacctatgaacctgtaaaatcaaaaacaagttagttactcccaagatacaatggggatacagggattgggaaaatattcccattccaaaaggaatatatggaccaaaaaaaaggggctacaggctccatagaagtctgaaacccagaaggccagtcattaaattttaaagatccaaaaaattgttatttggctccatgtctaacatccagggcacactggtatgaggggtaggctcccacagcattggacagctctgtctctgtggctttgcagggttcagcccctgcagctgcgctcatgggatggcattgactgccttcggtttttccaggcatatatggtgcaagctgtcagtggctctaccattctgaggtctggaggacaatggcccttttctcacagctccactaggtagcaccccagttggaactctgtgtgagggctttaaccctgcattagccctccacactgccctagtagggaattctccatgagggctccaccactgcagcaggcttctgcctgtacatccagacttttcatatatcctgtgaaatctaggtggagactcccaggcctcagttcttgtcctctttgtagccacaggcttaaaaccacatggaagccactaaagtttgtggccaacatgctctgtagcagcagcccaagctgtacccaggcccctttgagccatggctgaacctggagaagctgggatgcaaggagcagtgtcccgaggcttcacagggcagcagtgccctggctctggcccatgaaaccattcttccctcctaggcctcgagaggggctgctgtgaaggtctctgaaataccttcaaggccgtgtccccattgtcttggctaatagcacttggcttctttttaatttatgcaaatttctgcagtctgtttgaattcctcttctgaaaataggccttttttttttctatcacgtggccaggctgcaaatttttcaaacatttatgctcggcttctcttttaaatttaacttccagttttaggtcatttctttgctcacacatatgagcataggatgttagaaacagccagaccacatcttgagcacttttcctgcttagaaatttcttctgccagataccctaaatcatcactctcaagttcaaagttacacagatccctagggcaaaggcacagtgcaagccatgttctttggtaaggcataacaaaagtgacttgtactccagttcccagtaagttcctcatttccatctgtgtccttgttagccttgcctttgctgtccatatcactgccagcattttggtcataaccattcatccagtctctgggaatttccaaactttcagtcatcttcctgtattattctgagccctccaccctcttccaacctctgatttttatccagttcaaaagtagctttcacattttcaggtatctttataagcaatgccccacttgacagtaccaattttctgtattggtccattttcatactgctataaagaaaacctgagactgggtaatttataagaaaagaggtttaattggctcacgggtctgcaggctgtacaggaagcatgatgttggcatctgttcagcttctgggaaggcctcaggaaacttacagtcatagctgaaagtgaagggggaacagggcttcaaatggccagagaaggagcaagcaaactgggcgaggtgctacacacttttaaacaaccagatctcacgagcattcacttactcagtgtcacgagaagcggatggtgctaaaccattcatgagaaaccacccacatgacccaatcacctcccaccaggctacacctccaacactggggattgtagctgaacatgagatttgggtgggcacacagatctaaacactatcaacattgcaacaatggtgttagccaaaagatagtgaaataatgtcttcataagaaaaagcagttatcaacttggaatttttaatgaaataaggacatttattatacaaacaaaaatagaagattggccaccaaaagaccctcctcactaaaggaacttctaaaggatagacttcaagaagtaattgaaaatggcctccaaaaagcaatctgaggtacagaaagaagtgatcaataaagataaaagtaaacattaaactgacagtagcatgttatagaaaaacaatgatgcctgtttcaatagcattaaaaaaaagaaaagccaaagtaaggttagaggcagattgttggaatcaaaaccctaaaagcttcttgtattttcaagaaggaaagcaattgattgtctttggaccttaagtatgcacagtaaaaactgcagtgaaaagatgggctcacatgtaaaatggtgtcttttaatcaaactcagtaaacactttctcacggaagatacctggatattaaaggatgtcagcctattgattccccacagcccttgtagttaaagcctgtcagttgctgcattaggtttcctgtcagtaatcttttcactcttcctctcatcaagttcattatgtgaagttacaactctttacggacctctgtgtgtttaataaaacacacgtgctgtgaaatcactttaactccttctacagtcctcatgatgaggaccagtgcttgtcattcattagcatccagctcattgtgttttgcttgaagagcctcaccaagggtccagtggcaacagcggcactgtatgtgtggttgtcaaatcagagcagttgcacctgctctagagagccttcccagcccactttagtgcacagtagtcccttcttcccctgaattctgcttgattgcacccatctgtctcacgtaagatggaagtatcaatagtaccttactcttagcattacggtgtgagttaaatggattaataagtgtcagagcacttagagcagtgcttttatagcacaccaactaaataccgttgaataattgctccctagttatctttttgggaggattataggttgtttcatccatgtgttagattactaaattgtaactggccaaagataaggttaagttttatacttctgtgggaaatagaaaagtagactgcagtaagtgagtacaataagtaagtcagttactaagtaactgacttagtgggcattagtcactcatgggtgacttttaaaatcacatttcgcttggagagctctttggaatctctttgtagtaggcttagtgtagtaatgagaaagagctgtttaaaattttgtaaacatgtacttggattaattgatctactgcgaaagtagaaacgtagatgtgtagatttttgaactaaagggatcgcaagatgccaataaattagttttagggctcggggaaagcctttgtacttcaggacctatggctcttctgttaaaaacaaaaatattttctccaggttccattccagcattagccaatgctttgccttcagttctaggaattacccacattttaaaatgaagcaaaagtacagcagtagagtgacttgttaggggctggtgggtgggaggatagttttcagaccaggtgagattgtgaaggggctggaaaccagctggtctgctttcaagtcaggtgcctcctgcacactgtgccacctgaggccctgctctgcagcagccctctcagccctggtctcttctgtgtgcgcagtgctcatgttggcagtatcagaatttcacatctattgaacaatgtagtgaatatttattttatatgtgatgtatggttatctgtttatcttagttgcttttttgctttataacggaaataatggtatgcttttttttggttatatgtatttttagtatacctttaagcctcacctagtggaggcagaagggatgatatttattatctcccttggaaacctgcagggtggatattttgaatcctttcttgccaggtggatatctcagcatggtgttggcaggattgcctgtgttctgtaagtggctattcacctagttccaagtctaagaattcttgagtattcagtcaaaagagatttaaaggatttggttgacaataatgtactttctaatgtaatcaggtatccaggttaaagacagaccacagacagccacatgtttgatacaagagcatgagtaaatggctctccctgtctatttcagcagacatgtttagaaaaatgatattcaagcaataacattttccagttatagattttaattgtattaagataataaatcctaaactgttttgctaatctattgctttttgctttagaacaatttgtaagagtttatacaagtcagtagagaattcatatccagaaaaatataaacagaagaaatctaaggacttctgaaataattaattattttggataatttgtatgattgtgtttaatgtctgtcttgcagtatactcgatttggtgaattctaaagatgaaggatacctcctgtcaagtcatacatagtctagtgaaagagacatttagacgaaaatagtacattacagcaagatcctcagtagagatatgcacaggttgcaataggagtaataacatttaaacttgcactctggttgaggggggtatgggagaaatgccaaaagtggtcctttcatattctgagactacttcgtgatttctagagtctctgaagaagctataaaggctctggtacatgagctctttaagctttctcttggattgctatgtatttccagtatgcttcctgtgcttacccagtctgttgtcagccatgctacctggtttttcagccttctactcttcctagttgtgggaccattagcaagttattgccttgtgtttcagttttgtaagaagagagaaatagcaccaacctggtaggagcattgtaaatattaagatcgtatatggaaaacattttagaatgccgcctggtacaccataaggctcagaaaattttagttcttattgttattactttcggtagctaggtagaatattgaaacactgtcaccatgttgatcatttagattctctttctaaaatgctgatgtcaaataaaattttacattttttccccctttctagctccaagaggaaaacgaggatggaaaaccttttatgctgtactgaagggaacagttctttacttgcaaaaggtaaaagtaaagcagataaaaaatccacaaaactcgatgaaataattacatgaggtccagtatatgtatgtacggtagtctcccttatctgtggtttcactttctgcagtttgtttgctgatgttaaaaaattttcagcggagaattccagaaataaacgattttaagttttaagttgcatgctgttctcagtagcgtaatgaaatctttctcaatcctgctgcatcctgaccagctgtgaatcatccctttgtccagcatagccatcctatatatgcccatcctttaatcacttaatagacatctctgtgatgacatcagctgtccagctatcgcagtgtttgtgttcaagtgacccttattttacttactagccccagagaacagtgatggtggcatattgttatcattgttctattttattattagttattatggttaatctcttactgtgactaatttataaattaaattttatgttaggtatgtatgtataggagaaaacatagtataccgtcatccctccatgcacacaacagattggctccaggacgccccttaaataccaaagtccccacatactcaagtcctgcagtcagccctgttgaatccacatataagaaaagttggcttctgcatactcgggtttcacgccccacaagtgccatattattagtcctcatttgatggaaaacagtctgcatattagtggatctgtacagttcaagcccattctctttaagggtcatctatatatagggtctcgtactattcaaaatttcaggcgtccactgggggtcttagaatacatcccacatggatagataaggggagcctactgtagcacatattctttattcatcgttcagtggacacttaggtcgtttccaccttttgtgagtaatgccgcaatgaacatggggtgcaaatatctcttcaagatcctaatttcatttcttgtggataaatacccagaagtgggactgtggggtcatatggttctgttttcagttttttgaagaaactccatatggttttccaaagcaatgtaccattttatacctgaacaacagtacataagggttccagcttccccccatatatgtgttgaatttgtctgagctctgtgttccattctgttggtctatgcatgtgtctgtctttatgccagaaccatattgatttgatgttgtagcttggtaatatgttttgaaatcaggaatgtgaggcctacagctttgttcttctttttcagtatgatttatggcttattcagagattcagagtcttttatgattacatataaattttggaatttttttttctttttctgtaaaaaattccactgggatattcacagggattttattgaatatgtaggtcgctgtgggcagtatggacattttaataatgttaaatctttgaatcctgaatccctgaagatggaatgtcttttcatttatttgtgtcttctttaatttctttcagcagtgttttatagttttcagtgtatatgtcttttgccttcttgatcatgtttattcttaagtattttttaatagtttttgatgctgttgtaaatggtattattcatttccttttcagattgttcattgttagcatatagaaatggaactgatggttgattttgtatcctgcaactttgctgaatttatttattctaataggtttttggggaatctttgggttttctacatataagatcatttgaaactgtatctgttttgagggtttttcaaatcatgaaaggatattaatatcatcgctttcctgcatcattgagatgtttgtgtaatttttatcatttgatctgttaatgcgttttatcactttgactgattttcatatgttgaaccacctttacatcccaaggataaatctcacttggtcattgtatatgatccttttttttttttttttttttttttttttattatactctaagttttagggtacatgtgcacattgtgcaggttagttacatatgtatacatgtgccatgctggtgcgctgcacccaataatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagtttacagtcccaccaacagtgtaaaagtgttcctatttctccgcatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcaaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctagccagttttcccagcaccatttattaaacagggaatcctttccccattgtttgtttttctcaggtttgtcaaagatcagatagttgtagatccttttaatgtactgttgaattcagtttgccagcattatgtttagagtttttgcatttatgctcataatggatgttggcaagtagttttcttgcagtactgttttctggttttgatatcagggtcatgctggcctcataaaatgagtttggaagtgttccctcctcttcaattttttggaacagtttgagaatgattggcattagttgtttaactgttaggtagaattcactggtgaagccatctgctcctaaactttcctttgttgggagggttttcattacagattcaatccccttattattacagatccattcagattttctacctctccgtaattcatcttggtagattgtaggtttctagtaatttatccctttcttctaggtttcccaatttgttggtgtataattgttcataacagtttcttagaatccttttagtttatgtggcatcaattgcaatacctcctgtttcatttctgattttatttatttgagtgttctctgtttttttcttagtccagctaaaggattgtcaattttgttgatcttttgaaaagaaatttttagttttattttttcatttctctatttcttttatttctgctctaatctttgattagattttcatttctctatttcatttatttctgctctaatctttactgtgtctttcctgtgctgactttgattttcatttctctatttcgtttatttctgctctaatctttattgtttctttcctgtgctaactttgcattactttatctggtgtaaaaacaggttgtttatttaaatctttcttcttttctaatgttaagtgtttattaccataaacttgcctattggtactgcttttgtttccttccacaagttttggcatattgtttgtccatttttgttggtctcaaattattgtccaatttcctttttgatttttttttgacccattgattgttcaggatcatgttgcttaatttccacatatttgtgaactctccattttccttctgcttttaatttctacttccctttctttgtgattggacaatatatttggtattatttcagtcttcttaaatttggtaagatttgttttgtaacttagaattttatctatcccagagaatgttccatgtgcacttgagaagaatatatattctcatgctgttgagtggaatgttctgtatatgtttgctaggatatttggtgtattgcatttttgaagttctctgtttctttattagtcttctgtctagaagttctgtacattatagagagtggggagtggaaatctcctactattgttaatttctaccttcagtcctgtcaatgtttactctatatatttacgtgccttgatgatagatgcatatgtactaataatggttacaactgtgtggtgaattgactcattattatatgtcattctttctctcttgacagttttttacttattttgtataatataagtatggctacccctctgctctttttgttaccaattgcatgcaatattttttccattatttcatgttcaggtgtgtgtgtctttaaatctaaagtgagtctcttgtagacagcttatacttgggtttttttttctctctctctctgcatctgtccctccctccgtctgtctctgtctctctgtctctctctctctcaatacattcaaccacactcccagctgtgattgggagtttaatccattcatatttaaagtaattatcgatagagaaacactcttgctattttgctatttattttctgtcttgtcacttttttacttcactcttattagtattcctttttttttttttttgtaataacatttctttattctcattttcttttgggtatcttttagggttttttttgtttgtttgtttgtttgcttaccatggggcttacataaaacagttataatgatctattttaagctgataatgatttcaggtcatatgccaaaactatacttttactccgtcacaaattatatccttttgtattctgttcccactaatgtatatttataggtaaagtattttaatactttttttaaaatttctataccagagttaaaagtcatttacacaccactattacaacattaaagcattgtatatttttcctacatatgctcagcactgcatatcagtgattgctgcatttgaattcaaccaacctgagattgaaatattcagaaaaaaaaagttccacaaagtttcaaaaaacaaaacttgaattttctacatgctgagtactatgttgaatctatgccaatgaagtgatgtgtaggccttttattaggtatcatgagtaatctagagatgatgtaaaacgtgtacagaaggatatacatatgatatatgcaaatactgtgtcatgttatgtaagtgacttgagcatccatggattttggtgtccatcaggggtcctagaacaaatctcccacggataccaagtcctgtctctgtttacttttgctattgagctttatactttcttgtttctgtttagcattctttcatttcaagttgaactccctttagcctttcttgtaaggcaagtccagcagtgatgaactctctcaactttcgtttacctaagaaaatattatctttctttcttttgtatatatataatataatatataaataatataatatattatatataatgtatattatttatatattatataatatattatatataatgtattatattatttatatattatataatatatagaatatatattatatattataatatatattatatataataatatatattattatatataatatatattatataatatatataataatatatattatataatatatataataatatatattatataatatatataataatatatattatataatatgtatataataatatatattatataatatgtatataataatatatattatataatatatatataatatatattattatactttaagttctagggtacatatgcacaacgtgcaggtttgttatatatgtatacatgtgccatgttggtgtgctgcacccattaactcgtcatttgcattaggtatgtctcttaatgctatccctcccccctccccccgccccacaacaggccccggtgtgtgatgttccccttcctgtgtccaagtgttctcattgttcaattcccacctatgactgagagcatgcggtgtttggttttttgtccttgtgatagtttgctgagaatgatggtttccagcttcatccatgtccctacaaaggacatgaactcatccttttttagggctgcatagtgttccatggtgtatatgtgccacattttcttaatccagtctatcactgatggacatttgggttcgttccaagtctttgctattgtgagtagtgctgcaataaacgtacgtgagcatgtgtctttatagcagcatgatttataatcctttgggtatatacccagtaatgggatggctgggtcaaatggtatttctagttctagatccctgaggaatcaccacactgtcttccacaatggttgaactagtttacagtcccaccaacagtgtaaaagtgttcctatttctccacatcctctccagcacctgttgtttcctgactttttaacgatcgccgttctaactggtgtgagatgatatctcattgtggttttgatttgcatttctgtgatggccagtgatgatgagcattttttcatgtgtctgttggctgcataaatgtcttcttttgagaagtgtctgttcatatccttcacccactctttgatggggttgtttgtttatttcttgtaaatttgtttgagttcattgtagactctggatattagccctttgtcagatgagtagattggaaaaattttctcccattctgtaggttgcgtgttcactctgatggtagtttcttttgctgtgcagaagctctttagtttaattagatcccatttgtcaattttggcttttattgccattgcttttggtgttttagacatgaagtccttgcccgtgcctatgtcctgaatggtattgcctaggttttcttctagggttgttacggttttaggtctaacatgtaagtctttaatccatcttgaattaatttttgtataaggtgtaaggaagggatccagtttcagctttctacatatggctagccagttttcccagcaccatttgttaaatagggaatcctttccccatttcttgttcttgtcaggtttgtcaaagatcagatagttgtagatgggtggtgttatttctgagggctctgttctgttccattggtctatatatctttcatttttaaagggtagttttgctggatgtaatatgcttgtgtggcaagtgtttttgtttgtttgtttgtttgtttgtttttttgagcaccttgaacatatcatcacagtcacttctggccctggatcatttatgctgagaaatacacagaccaatcacttttcttttgctactttcaaagtcctctgtttttctttgactttttataatttggtcattggtcccagtgtaatttatttccattaatcctggttgtcattaggcttctcgaatctggatgtctgtttccttcctcagatttcagaagtgttcggtaaataagctttgtgccctctttcttctttctgctctttcttggatttccataatgtgttggtctgcataatgatgtgtataaggctctcttaactctttttcattcttatttatctttgttctctgagtggataatttcaaatggcccgttttcaagtttgctcattctttcttctttgttttctgctcttgagcctctcatctgaatttttcatttcagttactatattcttcagcttgaaaatatctatttagttcccttaaatattttctctttgttgatattctcattttgtttattcatctttttttagcttgttgagcatctttacagtgtttatgcaggtaattcttatacctttgtttctttacggtcaatttctggaaattcattttgttccattgaaccatgttttcctgtttgttctgtctcttgtagctgtattgggatctgcacatttgaagaatcagccacctcttccagtatagagactggcttgctacagcagaagcccctcaccagtcatctttgcaacagattttagggaactctgaatcctttttcaggagcccataatccttgcaccctttgatgtctgtctgcaacactgcaagttatctgattttagagcaggaagctacccagctgtcccctgttctaagcagccaccaagtgtatgccatcagttccctgaatcaggagagtcagataccactccctcagatagccctccaaaaagccagaatgctggatgcatactctgctcctctctctctccctcccaagggagaaatcaagtacactaagtgtgccagccacagcaagccacctgtctctctactctgttctaagtgtccttcaggcttccaagctatgctagttctgttagtgctgtgagtgaggtgagaaagaaattagtcccttggggccaagaagagctgaaatgagggccacacactctacctttcttcagccctcccaaagtagaagcttcaggttgaccaccttttctcccaattgcatcaagctgtgctgactgcagcgaaccacccaccactttcctttgttcttagcagtgcccaggtatccacactattgcagttccctcagtattccaattgaaccaagattaagccattacccaggcagccctctgaaaagccagaatagcaaagacctctttcctttcccccatcagagatgtcaggggccagggcattctcttctggtgctgaggcatgctagcttcagggaggggttgatgtgggtaagatgaaatcactcttcttacctgtttcagcgtgggtttcttggctttgtgctctcctggggtactacaacctcttcactggattttggtattgtcttagtaggtattttggtccataaatcattgattactcaatatttttattggggagatgggagctgggactacctattctgctgtcttgctaacagcactcccaggaagagactgtttaaatctatgtggaatcatagtataacacagttttggcgtcttattcttttcactctgtatgttatcataaacagtttcttattaaaagttttttagaaacatttttggttttcatcaatctggtatttggtgactgtgaaatgatatgtaattatggttttgtttcttctgtccctagatcatttataaacatattcatttttaaatgcatgtagtattttttgttaaatagatttatcataatttaacttttcccccactttcagacatactcttttttagtttttcatttataaaataacactgcacacacacacatgcacatatctcttttattttcttaagattcctaggggtgtcatggggcacatggtaggaactgtttacagttctgaaaacatatttctaaattacctccagaaagattatacctaatgtcattccttacagaagtttgtgacaacatgtctgttttcagtgtattattgacatatgggtattcagaggaaaggatctgaaaggattcattttgaacttcttgtttttggtgtttgtccacgaacacatgtccttccactctttacacactgctgtagttgcctttccacacctgtgtttctctggcaaagaggcctcccgtttgatttactatccgcagtactgaatcagatggcgacccctcatggtatgcacgcttgcaccactgagatgatcaactgctttggaatggagactgggaaggaatacatttgatttattgttattttaaatttttcaaaatattataataatgccatatatgagattgaaagaattattcttttttaaaactagccttcctttgtccacccagatctttatttaaaggactttatatttcaactatactgtatcttttttgcttttttattgttgttgttgttgttttctttgcttgtttttgtttttttacaaaagtttatttttaaatgttcaacagattccaagacagcacttcattttagctgtaggtggcaaaatatgttatggcagggaatacagatgtttaagtaagaacggaaggcaaggatcaccatcacctcagacgcaaagaacaacttacttgtggacagatttcttaaatcaaccttttgggcaggggacccttgcccacagcctttgctttcagctccagagtttctttgtcttttctttttgtttctgcttagaagccctcgcctcctcgcccatctccttggctcatttcagggctgcttcttgccactttgatggctggatctggtgcctgccaccccttctccagaccctgccactggaaacccatatctttcattaacattttacatattaccagagcagctttgtaaacaacatttttataattattttttgttttattttttatctgaactgttttcaagtgtccaaattaggaaggaccatatctaacacaaacccttttgtcatcttccttttggaatacatcaggtaaggaatattggagcatggaatgcttcaccttagaccatgatctctttttgggaaaataggctttgtagaaagagatatggagttagctgaaacccaaagatcacaaagtaaatgatttgccgcatccttctaaaattctcacattactttgagggtcatgacaagggagaaatggaggcagttgttgatacttggagattatccatgctcttaggtggctggctatctcatactgtctttattttcctatggagtctataagcttgttttcctgtggagtcctataagcttctagtttataagtcagctactctggcctctgccagatcagcatgtgtgtacatgctgggcccacactggtccttttagctacctttgtctctgcaaggaagaaccctttgaaattaaatttcacatatcacagccatttccccagcataaattccactctcttgggtcacttctttattttgtctaaaatctgtgttaaggggcatagctgcctttggcaaaaccgtttctctgaatacctagccaccggatttccacccactccatctcagggtgggcctgggaagagaacactattctcacattcaacatttgagaggagtgatgccaagaaagatgctgtttcaaaggtaccagcttttcctacatcactgtcctctccctcagataaatgtattgggagtttgagtcatcaagatggagaatgggttagtattgacaagggaacaactttgtaaactttgaagcttcagcatcagcttggattagagctccaagaaggttgcttctccggatttatgatagctctggagtgtggcaaatgtgcatttgggcaaagttgggtgaaattgcttttataaagagaaaagcctggcagtaaggaaattatacatttatgaagagtgaatagtagaatcatgggttattgttcgggttgctatttcagttaaatcataagaatgctagcatagctgtaaactatctacttacaatgagaataagcctgcaaaagggtggccatgtttaataaccagtctccactctcttcttaatgctcttttttaaaaaatcagaactaatatatgttcctggaaaccttgcacagatcctagagactaattcctcaatcaatggaagcttaaacttcatagttctgtgtcttgtatggctatatctacctgattgtgtggtttctacctggttctgtagtttcttcttaatctgtaaaactaaaaactaaaaaggtaggtagactgtacaagaaggaagaccttatgggcatctacatctggaaatgccactccctcttaggttaataggatactgcctgctgctgagcagacttttgcatcatagcgttctttggggtatcgagccatccagcagaaacaggagtagtagatagttaaacttcttccccttggccaggttgtagcatgtgttaagggctaatcctggtgatgtgtgcatcctacagggagttactaatgtcccactgctggttaatccgtccccctggttggaagcctaatctaccagcatgtgatagcagatgctacacaaaaagtaaattatatgattacaaggtggtttggggtttatacagtttgggttttatatcctcccaaagctatttatcacatcaggtactgtgcaaaattctaagcttccaaagacaactaagatacaatccctgcctacacagagctcacaaaataggaggaaaacagataaattgagcattcactaagcaatgagatgaattaatagaggcgtggaaaaatcttactgaagaaggccccctaagcatacttgcaaaggtcagaagatgcctccctgaggaattaacatgacttgaactgatgcctgaaagataagcaggagtttgccaggcaggcaggcgagaaaaagcattttagcaagagaagggtgaaaatagcagatatgagagaatatggcatattcaaagagtggcaaactactttttacatttgcattataggctggagggggagtagcaagcagtagaaagatgatgaaaaaaattatgtttcaaatgatgaaggtatcacgaaaattaaagagatggtatcacaatgtcataaagtgtcccatttacgaaagaactgttttcttccctcaaggaatttcaagctctttgagtgagaggtcattgccgctgccacctatactcaggtactcaaaggacttaggtggcatagtgtcccccatgctaagcagccctcctcacaggacctgtgtggggcatgtgacctgggagtgccatgttgttctccgctctgtgctcttaggatgccagtatttacactcctaggattccagtatagcagaaatgtctctccttcttcttcccttcttcagccaatcccccactatttgggtgaggagaggagaaaaaagccctggcccaaagttagtgtcattcagtttgacaaaagctcactcatttggcctcctgtgtaacaggggctttgccagagatggggatgcaaagatcccaggatccggcgtctatccttaagggcctcactagcacactcaggctctacatccattctctctttctccacacctttctaccccatatacatttctcagcatcaaggaatcctgtccaagggcttccagttaacttccctcctgagtgccctccattttcccccttgcggctgccaacgtctcggccttggggataaatgaggggggtagtactgcctgagacagaaggaaacagggccactgcttccctgattaaatgaatcaaattggtcttcgaaagaattcataatggctggcaattccagccattccggaagtccataatggctggctttgaagaccaccttcccttcattgtaaacacatatataccacacacatacacaaaccaccccctgccccacccactggaataacaatctgtttagggtctcatttcattattagttgctcatcagttactttaagcctttcatcaagacttctcaactacgtaatagcgtataatgatttttacccatatagaacaattcaagaataattcaattcgcatttcttcattacaaatggagagtaatagtaaaggctttccccctccgaaaaacaaataaacaaaaaagtcacaatagtcatcagaaggaaaactaggcacagctgaaattacacaggagcgagtgccaagtcctcacagtctccattcgctcaacctctttcactactcccatcccagccaaagtggcttgttgcaaaggtttttggccactcctacaggaagttgaagcattaataaataatatctcatgcctcttaaggttgtggccgccctgtgtttatgctcccatatgttgcatgcctcctgaacacatgggcacagtgtcggcagcctcttaggtattaaagtaagagctttgttaggctggggatcgctctccccagcttcctcagatccccctaggaaaatatatctcttggaagagcattaaaaggctcttccaaaagaagagtcacaccttgaagagttacgaagagtcatactccagtaagtagacatgccttgtcaaactccaagtctgtcacttaactaattgctgatttggagcagttaattatcctctgcgaacctcaactcatttctgtgtaaaatgaggggaaatgatgttgcatggttgatataaagaaatgattaaatacatgaaaacacctgttgcacagtaggttaatagtaaatattggttcccttcctgacgactcttataagaaatgagagtattttttcttttagtcctttcttgattattagtcatctcataaggaataaagtgtctggtgtggttgggcacagtggctcacacctgtaatcccagcactttgggaggctgaggtgggtagattgcttaagcccaagggttcaagaccagcctgggcaacatgtcaaaaccccatctctacaaaaaatacaaaaattagccagacatagtggtacttgcctgtggtcctagctactcaggacgctgaggcaggaggattgattgagcccaggaggcagaggttatagtgagtcaagattgggtcattgcactctagcctgcgtgacagtgagagcctgtctcaaaaataaaataaaaataaagtgactggctttattcagaccttattttcctcccttttcacaatcttcctacagcagtctgtgtatgaaatgattaagagttaggccttctcaaccatccaaataaaggcccttactttccctggtacctttattgaaaaataagtaatttcttctacctttgtttccacttcagataggagacaaatgcctccataaatcctcctagcactagtgccaggcaaggcagagggcttcgtgttctggagctagcgatgtggcataaacacaggtcaaaaataccatatcaccccattcctcattcccatagacattaattatatatatgacatgacttctacatacttgtcttctagttagagaaattttaccaaagatcagacacatgcctccgctccctctccctctcaccacctcaaccctggatatttagatagtccctttatgaaaaaataagccataggctctacatacccgttccatgtagcaaaaacatgaaacaaataagcacaaggagccccccacctttttgaagagacatttaagagcagtattcccgtattaaagaaagcccacatagccctgcagagcatttctgtatatttcatatctaaaagaataaccactcccagatcagagcattatacatcacaaatgtaggaaacggcttggcagattgcctgagccagcttgcttcattggccatttagccagaaatgagactggtttgttagtataataggttgtaggttacttcttccatctgagcttcacaatctcatagaaggatactgttcccattttttaaattgaaaagctggcgttctaaagttgattaacctactcagtattgtaaagatggtactagccaagctaatatttttcccattagtgtcttcttaagtaaatatgaacactctagtgtgagagccttgtaattactggaagtttaaaatgctgttgtggggagaggtctctaactgttatgacttcacccagcttcaactaacttggccactgcacagcaactgtgcattaactttccttcagcctctgacttgaataaagaatgatggctttgccctttctctgattgcacttgcctggctccagccactctttcactgggatatgagactttccactctttcactggaaaatgtctcgtatcttctattagttgagtacataaactttgagattttctaacatagacctttttcaggtctattgttcccagaaaccatgaagtatgtggaactgttggcatcctattttatatctctcagattgacacttaaaatatggcttaagtatccagtatcagctgaactttggctagtaaactacctttctgatacagagggccataaatttacctaggaagcaagtcaataatgagtgcatatataagattaggactttgcccgtcttctagaatgttgtatactagagatatgattgtgagcaagatacggtgcccaaaggagctttcttcttcattctgaagaaattaacaaacaaaaggccaattcagtgcaatttgagaaatgctacaaagagaggagggtgctatggaaacacatatggaagggcacttaacctgagcaagagaagggaagctcatgaaagagttcatgaagaaagtgatatctaaccccacacttaaaaacacaaatggaagctagtcatataagggaactcagagacaaacgtgtatggatacttagatgtgatacagcgtgtttggggaactgcaggttcagtggtgtttgaggcagaagagcctagagaaccatgttaaagagttgagactttatcttagagcagttggagctatcacatgttttaaatggggagtgacctgattattttacttatttttttgaaactaggtctcactctgttacccaaactggagtgcaatggcggtgtctcagctcactgcagccttgaccccaaccaggatcaagcagtcctccaacttcagccccctgagtagctgggaccaccaccacacctgactaatttttctattatttgtagaaacgggatctcacttcgttacccaggctggtcttgaattcctcaacttaagcgatcctcctgccttgacctcccaaagtgcagggattataggtgtgagccaccatgcacagcatttatatttgtattttaaaaagatcaatctgggtcagatgcggtggctcacgcctgtaatcccaacactttgggaggctgaggcgggtggatcatgaggtcaggagttcaagaccagcctgaccaacatggtgaaaccccatctctactaaaaatgcaaaaattagccaggcgtggtggcacgtgcctgtaaaatcctagctactcaggagtctgaggcaggagaattgcttgaacccaggaggtggaggttgcagtgagccgagatcttgccactgcactccagcctgggtgacagagcgagactctgtctcaaaaaaaaaaaaaaaaaaaaaaaaaaagatcagtgtggctgcaggttggagaatgacttggaaacaggttctatcaaagacacagagaccagattaacttgaacaagggcaggggtaagatggagggggaaacatagctctacttggagagtttagtttgaggtgttgaattcagagtgtgtggaataataaatggatgtgtccagtaagcaattatgcatactttgatctggagccaatgaaggggccagaaatgcagatctgaacagtcattaacaaaaaattggtaatttaagccatgcaagtagatgatgtcactccaagagtgaggagaagatggaggacagagccagtggaccatatactcatatgtgccctaggaggaagagaaaggaggaggagcctgtgcaatgtggccagacagctaggaagaaaactaagccagagagaaaactggtaccagagatgttaagagatgtttgaaatgtgtcctgtcatgaaaaggtaagatagggaattggagagtgccacgtcaattcagcaagtaggaaattatcgataaagcagtttcagtgcagtggtgagcgtggaaggcagattggagagttgaggatgcagaggcagagaggacatagacaactactctcgagaagctcacccagaagtttccagtttgatccactccactcctctttttctcatattccccttcctgtgacttttgaaaataataagtccccggtgtctgtctcatttccattgaatcttgtttctttcctgttgttgattgaactctaaagtaaagtaagtccttatctttgttcctttcccccagacagtttcttacattatccagagctcttgttttgcttctctgagttacacacaatctgcctcatcaccatttgcctcattttcctttctggccacttccttaatgttacttagtcacatatgcctttcactttcaagcaaagagtaaatccacggagtatcacgatagtaatgtcagatccctttacaaaatgtcatgttgggagctatgtgagaaataaacatagcgtctggtccctgaaaacacttgtcctgacagtgtggatgagaagaccagtattatgcaatgaatggctagtggactcttaaaatcacctggtgaaaaagcaccagttaacatgatgtaaaccaagtgtataggtgaaggttggagaaaacacagggtgaatggaataaattcgggtgaacacttctttctacttgctataactctctgagatagagcttgtgatatacaacaccagcataggggctgatttaaatatttgcacatttcaaaactgttccagagtccaggtatcagtcatgatctggcataataggacttttatggtacagtgtttctgtctgttttatagctaagtaagagcacactcctatctgtgttttttctagtacttgcagtgcccctgagcccaagagtacctaaaaaatgtgtgccctattggtagttaattattactatgggaatgtgaagcgttcatggaagaaaagacaaatattattttaatataatactaatagttcatatgtgctttaaaaattagaaagtgctatgaattgaatgtgcattttaattgacattaaaatgattccattcctgttggttctgatgatccatcatggttgacatttgggtagtaacttcatatccacttcgttacagagtgagtcatccgctagccaagtgctttgacaagcctttgctatcacaaagcttcagagtttctctctcagtttctgtcatgggctttgtgtctgtccctgccagtctctgcttctctcttgaaagtatttttgtaaggcttgtgatgttattcttgttccagttctggttgttacaaaactgaactgccctagagatgattgatggaatggttaagagcgacgggtgtaggtggctcgttagtgcatggcagtgaattacttagagttcacctcttgattattgtagtctgcagatcaggctctcaagaatctctatgtgattttatctttagggtctagaaagcagctgttcaaacctgaatttatttacctttaccctgtctttagaagtgaaaaatcagttcgttatctaaaacgtacatttactatcacagatcaggaactgtgtccttggtgcagaatcatctttattctctggcttactcggaagagagattttgttccacctgcctataaggggtttttgtttgtttgtgttttgttttgggggcttgtttttttgtttgttttttgacacagattctcactgtttcacccaggctggaacacagtggtgcgatcacagttcactgcagctttgacctcctaggctcaaccaataggttttgtaaaagtttaattggaattaaactttttggtttttacaaaaccagtaggttttgtaaaagtttactgggtcgcatcaggggagggcttggttcaggcacagaaggaagccactgaggattcaaggcctcccagactgtgatgacagcaatcagtctggagctgatgtgcccaagactgtggcacccggagcaggtccatctctggcctggtctcctgtcactcatcctgctttcttgtgagctcatggcgtttttatttccttttgtgaaactgctggttctgtgctcttttacatgttgaaatagttattaggacgaagctgaatgagttttagaaagacgcctaatcagacatacttagcattttttaaaaaagatattcatcaaattataaaaaacatttttaatgccagtttcaaaaccatgaattaatagacaatttaggacccagcttgctttaattactaacatttttattaatttccacatagctccaagtaacaatgtggtctcactttccctttttatattctctcagtggaaatcaagaccatttcaactgtgtttaaaattgttttaagtacatgtagctattttacctatttaatgaggcatgaagtaaatagtacattgaaaactggagtctttaatatgctttttaaattgataagaattttaattacaatttggtcattttccaaattgtagtttatattacctgaaagtacaatttttcagacttgatgccaattttttgtacatatgtagatgatgtttatgttagtgtgttaagattcaacttcacaagaggtttaattaacaagtttctcagggaaaaaaagctttttatttcatgcttttaatggatttaaaataaatagcattgtgaaatcacattcttggtgtttattgggatggtggagtgctctaatgaatcctgttacataaaacgatgtagattgcagggaacacgagagagtaacatgtttttagtcatcattttcacccctcatttatttgagaaaatggatagtaattagatgtcgtggagcattttcttttcttacagaaaatttcttgattggatttatcttgctcactgtttcacatttagtttgcacagcaaatagtccttggtttgaaatggtttgattacgatgatttatccgttatttcttcctgcccaattctaccatttaaacactatcctctcctttagtgaaaaataaagatgtcagaatgaacttagtaggataaagtcatttttttaatccaattgtcaaccctaatgtttccactctactcttggttttgccctttgtgtgtgtgtgtgtgtgtgtgtgtgtgtgtgtgtgtggacttggagctttattttctagtaggaattcagaatgctgaaaatattttaaggtttgcattttgcctttttaagaaaaaatggtaaaattgtattatcaactagaaaagcggaagcttcctagacttaaaatttttcaacttcagtttagccctaattaaatagatcctgtcttccactgatgccgtatatagtgttctccttccagtataaggtaatctggcagtttaccttagagtttaggaaactaccttggaatagagtcctcttttaaaataatggtgcagttcttccaaggtgacaattactgttagctttttcctgggtctgtaataaatgtagcattaaatttttttttttttgcatttttaagagtagcataagaatgtcatcctttgagcttgattttaaatgaagatatcagcagataatatactcgaagaatatttatagtggctccaaatgagacagtctaagtcattcaatagtaatagctaccaattggttttgtgtttcctattcacctgtagcagtttgttagacattgtgatatatatctggagttcaaaccatcccaacggttacatagaagggcatgaagaagaagagatagcaaaataatgatcagagaggtaggagagaaaccaggagggtattgtaacaaaaagctgaggaagaatttcacaaatcatggagatgtaaaagaattgtaggttggcactggatgcagccgtagctggagaccttaaatctgtcttagctacagtctgcacaactatgtttattagttttgtcagcaattatcaacccaagtgaatggttacataagggagaataagggtgggactttttagtttcagactaaatggatggctaagaaaagtaaggcatagcctagcaaaaaatcctgaatcctaagattaaaggaaaacccatatgtgattcctaagagaaaaaaacaagaaaaagagaaaataattagattggcattggacttgtattaaactggaagctagaagatggtagaatagcatctccagacaataagtaaaaccaatgaagaagactgcagccatatgttctatatccagttctatacctatcaaagaaatgaaagatacttgaggataagaataaaacagtataccacctacctaaagaaaatacttgagagaagagaaaatagcaaaggtatgagaggagagaggtcaagatggaaaaaagaaagaagcaggtgagcgaggaaacatagatgcagttaaatctatgaggggagactcagaatgtataatctaaattcaaaataaggcttcttgaaacagaaaatgcataacacaagataattttagtaagattgcagaacaaaacatttttcaaagtcttatcttgttgatgtgggtgaggaatagataaacagagcattttcgtaaaagaaagactcttttaaatttccatcttatatgactaagcattaaacggataaagaagaacattttaagtaataagtggcacatagttataaggaagatgatagttataaacctaaatgcaccagacaacatagcaactaaaatatgtataaaacttatcagaaatgcaacaagaacttgaagtggaaaaggttaatatacgtgtctgaaggggataaactagtagaaaaaatgatgtaagggcagaggaaccgagtcaataaacttgaatataaagacacattcattcctcaaagaataaattttttgtatgtttatggaacattaacgaaaatcaaacatgtgattggccacaagaaaaaccttaccaaatttggggaaaatagattttctagaccatattctctggtcataagccaataaaattatgaatatctaataatatataactaaaactttaccttaaatttgagaagcacattatttgatattactaagattaaagaagagataaaaaattaaaactacaaactatctagaaagcaatgaaaaaatactcttctttcccaaactctgctacacagtgtaacccatactcagaggaaaaattgtaaccttaaattctttcttaaccaaagaagaaatatggaaaacaaaagaactaggtaatcatcttaagaaattcaaacaacaacaaaatattaattcaaagaaaatagggaagaggaattaagataaaagcttaaatcatggacctagaatataaaaaaaaaaaaagtacacacaaatttctaggctaacctttgtgcaaactcaatcattaggtgtgttaggggatcagtatgtatggaaatggaggtggcatataaattccctcaagtgattttggccctcatcatttctcctcattccagttatttacctacctcatgtttttgtctggaatctaagttacactgcgtggagagccacatgtgccgggttctgttatagcgtaattataaggccagaggggttttgtagtcatgctacctctagttgaaattcctactctgatgaaaatttccctggaaggagatttgtgaatatttggaatgctaaattactgagaaaaatctcatttaaaaaatgacaaggcagatcttaaaacataactagattatagttttatgaattagtgggaattagtaacaggtacatataaataccttgtatttgttttttaaattctcctttattcatcataccactcgagaagactgtcattgtcaatagcacttcttatcctgggaggcttaataaagtaagacttgttgcaatcccaaagtaacaattttgtcgtttaatattataaatgtggataatctttatattaccactggtatttacatcatattgtagagggaaaacctttgcctcacagcattgtcacatgaaggattatttttgactcaatttgaattgatggcaatagtacatttgaactgcttggtttttggaggggataaatgaaagggaggggaagtatggaggactggcattgtttttgtgaaaatttgtaaaagcagactgataagaaaacagacaatatctttctttaggcttttactactaattagaaggtgatgtggtgtgtgtgttcgggggtacacgtgtgtgttttacagaatgcatgtttatcttgtttttgataaaatatgggaaggaggaagggaggccttaaactctagaaaatatctaacagttggtagcatatgcatttacctatttttcagtttttgataacaagctaagctttcacctgattattgattttcctcttttctttcagcagaagagctggagtaattattttattttactattcatttttcttttgataatattagtctaaacagaaagtaacaggaacatgtaatatcttcagagcaaagaacacaatggcattgtttttatcctcggtataattctgttgacagttacctgtaaggttgtgcttttaaccatttaatcctgaaaccaaatcacactattggtccaagtctcatttctgttcattataaaatgtgtacgatagatatttatttctgcctttggccttacttagctatttacctcaattattgtatatcagttttttaaaaaaactgatttttaaaaaaatgccttgggtagatgtattttctcattctcagcaaatttttcaaacaacataatgttctgtaacatttataaggttgtttttactcaccgtttgtttcatttttttcattcacttacttggatttcctaaaaactatttttttagtttttgcttttaaaaaattaagttgaaatctgatcgtgatttttgcctttattttctttgtgtccatctataggatgaatacaagccagaaaaggccttgtctgaagaggacttgaaaaacgctgtgagtgtgcaccacgcattggcatccaaggccacggactatgagaagaaaccaaacgtgtttaaacttaaaactgccgactggagggtcttgctttttcaaactcagtatgttttgttggtttttatttgattttgtgttttagttcacttagcactactttattgcaaggaacaaaatcaagctctgcaggggaaattttttgagttggaatcaaagtcatcaactgcttacattagagaaataactgcctaagaagattagagtaaaaaaaaatagaaacccaggatttacatttttacctgttacaaagtagccctttgacttttagtcagccacttaccatctctagaattcagtatcctcatcaataaaatatgagggttttagtagacaagttttatcgcaaaatgagtaaaacagacctagataacactgtttctctagctctttctcctagcacatagtttaacctctgaacctcagctcgtcactagtgtgggggataacgtttatcttacagagttctagtgagaagtcagtgagataagtgtgtataatacctcacacagtgcctggcacataggaactgttcaataaatgtaaatgtttatttttttgtttcccttctgagctctagtagtccatgattatactagaaggaaaagatgtcattctactgtgagcaaggaaatgggatgaattgccagttttagggggaggttataaggaaacaagttgcccggggtttttgagtgtaggaatgggatggttaacatcacacagggacccatagctggatgtataattacagctattgggcataaagaaactttcaaattattctgttccctgattttttcaatcaaaaataccagatgtaataactaaggagatctaattactttggacagaattgatgcaaaaaacagtccattgaaataataatggagccagagagatcagcctagagagggtgccgtgaggagctgacatttagagtggtctcaggtttgtttgtgtggtttctctcagagtaattgatgaaggaaatgactttggctgactttttttttactttttgtttattgattatgtgtatggtagataatctgtcctgattcatgatcatttctaccattcatttatgagtttgcaaatatttattaagtgctgtgaatcttgggctttctggatataatgacacataaattaaaaatatgatcacatcagatgattttcacctcctctcaggtgggttttctaaatagtcttattgaggtatgctttacgtaccataaaatatcaccagtttgaaatgtacatttcagtgatttttttagcatatttacagaatggctcagccatcaccacaatctagttttgaatcatttccatcactccaaagagatccccgtgcgcattttgtagtcactgccattctcacctccagccccaggcacccactgatctactttctgcctctgcagtattgccctttctggacacttcatataaacagactaatatatgatgtggtcttttgtgtctggcttcttttatttaacataaagctttggaagtttatctgtattgtagtgtgtgtcagtactttattgctaaatactgttcagttgtgtgcatttactgcattttgtttatccatttactggacaatttggattgtttcccttttttgactcaggaatgatgatgctataaacactaacatacaaatctttgtgtatctgtatgttttcttttgagatggagtctcactttgccaccctagcctggagtgcggtggcgtgatctctgctcactgcaacctccgcctcccaggtacaagtgattctcctgcctcagcctcccaagtagctgggactacaagtgtgcaccaccatgcccagctaatttctgtatttttagtacagatggggtttcaccatgttggccaggctggtcttgaactcctgacctcacgtgatctgcccacctcggcttcccaaagtgctgggattacaggcatgagccaccacgtctggcatatctatatgtttttatttctcttggatagttacttaggagtagaattgctgggacgtatgatacatgcacagttaactttcgaagaacctgtcagctgttttccaaagtagataaatccttttaccttccctctaccaatgcattcctcagttagattttaaaattaaacagtacaattagaagagatgagtaaattttataatttatttttggcctagcctcgtatcaaacagaaagtaggggtttaatcaatatttattgtcaagtgtttctcttttttcccttctgtttcctagggagagaatcacagtctggcactgtgatgatcatagcttctttggtgatcgtcgaatgacaatgttcatctctaatgaagttttgtcagggattagttgtaccaggaggagtaaatgattttcacatgccattgcaaatcagtaacgtgaaataggcaaagtgtgatgctacttagacatggcaatatcctgatataaacatatctatttctcataggagcccagaggaaatgcaagggtggataaacaaaatcaattgtgtggcagctgtattttctgcaccaccatttccagcagcaatcggctctcagaagaagtttagccgcccacttctgcctgccactacaacaaaactgtctcaggtaatcatcttgatagtgctttgaccttgggaaaaagtactttgtaaaataatgtgataaatatttgtctttggatagtagtccatgttttgggggcaggtgtgagaccttgccctgtgagagcgtatcatataaatgaggcagatatgcagtacactgggttttacacttcatgtaggaagctgacataattgagtctcagttagtaggacacgtactttgattcagtttctaaggtttatattagttcattatgagcaatacttgatgttttgtttgttttaactgccagctcataatctggcttggtaacaagcttttcttgcattcatttattagctcatttttattgagcatttaccatattccaggatgtgtttagtgctagaaatacaaaaatattttcaggaatccacggttcatattacaatgggaaatggcctgccctacccctcagagcagagctgaatggaacatttggattttccaagctaatgaagataaagtataccagaactctgctccaagtgtatttacataagcctccttctgtggtcagattaatcttactaaaagccatattttatcatgtcctttttcacttaaaactcttctaaggacactacctaccagctaggtttgctcattttaaacctgtctgtagtacccccttgccattgactagttaaagattttggaagctactttgatgtctttgtgaatttcttattacatagagacagttttatcttactatgatcgaccaagtgttggtattaactagctccctatacatctttgatatcataagatgtgtcccatggcaagagagggagcaattatcaatgatagattaatttaataaatatgtattgtgtgcctgttgtacatcagagactatttttggccctggagatagaaaggcagatgaaggccagatcctctgctgaaggtgtggcaaatataaataaggaagtcattgtaaaatgatttgatagaagtacaggaaggataagtccagagagctgtggaggttcaaggaagggacattatctagcctggccttggaggtgaaggaggaaatgtggtacctaatgtgcagcttaaaggatgagaggcagttaggtgaggtgtgggacgagataggaaaaagagccatcagaggaacgaaggcctagagaagagagcgctggatgcaggaaccacacacaagttattaactgtgacatgagcacagtgttgagaaaaagcaagaaatgtacctctgcagaggtcagcaaaggccaaatcatgaaaggccttgtttgtcgtgtgtaggattttggatgctgctgtggttcccagcatccttaaaataatagctttaagactgggcacagtggctcatgcctgtaatcccagcacttttggaagccgaggtgggcagatcacctgaggtcaggagtttgagaccagcctggccagcatggtaaaaccctgtctctagtaaaaaatacaaaaattagccaggcgcagtggtggatgactgtaatcccagctacttgggaggtggacacaggagaactggttgaacccaggaggctgaggttgcagtgagccgagatcatgccactgcattccagcctgggcgacagagcaaaactccatctcaataataataataataataataataataataatagttttaagcaggacagtaatgtgatcacatttttgctttaaaaattattctcattacaatatgagaaattgttagaagaagatactacttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgaattcattgtagattctggatattagccctttgtcagatgagtagtaggttgcgaaaattttctcccattttataggttgcctgttcactctgatggtagtttcttttgctgtgcagaagctctttagtttaattagatcccatttgtcaattttgtgttttgttgccattgcttttggtgttttagacatgaagtccttgcccatgcctatgtcctgaatggtaatgcctaggttttcttctagggtttctatggttttaggtctaacgtttaagtctttaatccatcttgaattgatttttgtataaggtgtaaggaagggatccagtttcagctttctacatatggctagccagttttcccagcaccatttattaaatagggaatccccattgcttgtttttgtcatgtttgtcaaagatcagatggttgtagataagcggcattatttctgagggctctgttctgttccattgatctatatctctgttttggtaccagtaccacggtgttttggttgctatagccttgtagtatagtttgaagtcaggtagtgtgatgcctccagcttcgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctaccacatattctcactcataggtgggaactgaacaatgagatcacatggacacaggaaggggaatgtcacactctggggactgttgtggggtcgggggagtggggagggatagcatcgggagatatacctaatgctagatgacgagttagtgggtgcagcgcaccagcatggcacatgtatacgtatgtaagtaacctgcacaatgtgcacatgtacccgaaaacttaaatggaatgttcttccatttgtttgtatcctcttttatttccttgagcagtggttggtagttctcctggaagaggtccttcacatcccttgtaagttggattcctaggtattttattctctttgaagcaattgtgaatgggagttcactcatgatttggctctctgtttgtctgttgttggtgtataagaatgcttgtgatttttctacattgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccaaatgtccaacaacgatagactggattaagaaaatgtggcacatatacaccatggaatactacgcagccataaaaaatgatgagttcatgtcctttgtagggacatggatgaaattggaaatcatcattctcagtaagctatcgcaagaacaaaaaaccaaacaccacatattctcactcataggtgggaactgaacagtgagatcacatggacacaggaaggggaatatcaccctctggggactgttgtggggtcgggggagtggggagggatagcatcgggagatatacctaatgctagatgacgagttagtgggtgcagcgcaccagcatggcacatgtatacgtatgtaactaacctgcacattgtgcacatgtacccgaaaacttaaagtataataaaaaaaaaaaagaagaagaaggtactactagaagcagaaaggcccattttaaaggaattttcagtaatccagaggagagataaccaaggtagctgcagaagaaatggatcgtagtgaaagtgcttgagagaccttgaaagtgtagaatggacacttctggtggctcatggaagtagaggaaacaggctgtcattgtggcttggacagctggggactgtggtgtctgacctgcttctggagtctcacctcactgtctcttgatttccccccttgcttcttagactcctttcttggatcattttcttctttctgtctccaattcctgcagtggccagagctcagaagcagactaaggcacttgataagcaattttccaaaaagttacttagatttaatacaaacagggagaatgttgtgccaagaaaggggggaaaaggttccatgaagatttagatttaaaaatgtgatatttagtggctgggaggtcactgggtatcttagcccattttgtgtttctataaagaatactagagcctgggtcatttagaaagaagagaggtttatttggctcacggttctgcaggctatacacgaagcatggcatcagcatctgcttctggtaagaatctcaggaagcatcaaatgatgatagaaggggaaagggaaacagatgtgtcacatggcaagagagagaggaagggaaagtgccaggctctttttaacaacccactttcacttgaactaataaagcaagaactacctcattatcataagcgtggcatcaagccattcatgagggatctacccccataacgcaaacacctcttaccaggtcccacctccaacattggggatcacattacaacatgagattcggaggggacaagcatccaaactatatcattggataaccttagcaagaacattttggtggagtcatgggaagacaaaccacattggccttctttgatgggggaatgaatggaaggtaataaggaagtggaggaggaaaatgtgctcaagtgttgccatagttataaaaacagaaagactagtagtaagaaggaagaatctgtggtttcaggaaagattcttctgtttttaattcataattatcattaacatatattgaatgcttacttgtaagcattactattactgtacagttcttgcaggacacaatggcattgaatttttaagggtaataagtacactacaactttaaaagaaaaggaatgctcttactgatgaccagaaggtatgttggcagacatctccatctatccaactaaaatatgaactcttaaagcaaatgcatttctctgctttaaatatgcatacttaacataagcagcataccacataaagagcatgtcgcataaaaggtaaatcacattacacgatataaggggagggaaaaaatcaagtaactggaagcaaaaaaaaaaaccttccaaaattgagttttgctctattaattttacggtggactttcccattgttctttttcagtagtttgggtctttctcacattcagttctataaaagatccaggggagaaggtgagttgaactaaagagggctgataataagcatgtcattcatggaaggtgaatgtaacttagagcaacatatgagtgtttccttgattttccctcactaaaatctacagttctgtttactttatactttaaaaaatgtactgctttcctatttagggactgtatactagtaagtgatatgtacgtgaaaatgaatgtgttcatctgtttgcgtgttttccccagaacaggcaagcacacacatttatcatggtaggcactcttatttctaacagatgacttacactggaaccaaaaatagaatgcataatttttaaaaatgttttccttcattttggacataaatccacagagatgcaaaaacatgcatatgtagtataatcacaattagggattgaagattttaaataagaaggtaataaccaaaaagaaatatcctgcagtatcatgtaagacaaggtaaccgtatcatttcaggaatttaatttatttggaaagaaatgagatgatctccgccaccccactgaattgcatcacccagcatttgctttgtgggcctcagctttccatctagaaaaatgagatggttctagaatgtttttaaggaattttttttttttttttttttttgagacagagtctggctctgttgcccaggctggagtgcagtggcttgatctcggctcactgcaatccccacctcccgggttcatgccattctcctgcctcagcctctcgagtagctgggattacaggcgcccgccaccatacccagctaatttttcgtatttttagtagagataaggtttcaccgtgttagcaatgatggtctcgaactcctggcctcaagcagtctgcccacctcggcctcccaaagtgctggaattacaggcgtgagccaccctgcccagcaaggatttttctatccaaagctctgtattatttctttgccgagtcataaggtttgtttctaaagataagatttttagctttgagaaacacatatgtaaaattaagcatgtatttggagtagcacctgaggctcttggggatatctatactggggtcatagtgtgcctccagcaaatcctggaagatgtctggctgcccctaggattcctccagtacctcaaagactagctctcatcctttaacccaggcatattcgagcgcagcagcattaacattttggtgtggataattctttgtcgtgagggcctctgtgaattgtaggatgtttagcgatatccccagcttctacccactagatgccaatagggaccccccagttctaacaaccaaaaatgtctccagacattgccaaatatcttctggggtcaaaatccaacccactcctattgagaaccactgctttagccagtggatgtgaagccgtgagaccagctatctttttttccccatactcccacaacctggctctgactcccctaaatgccacaattttttggataattttactttacaaaatacaggtataaaaatgtgagtgccttgctggaaacattgataaagaaagataaacagtgtggggaaaaattagacgttcaattaaaagattgtttggtgctttttcaagacacagtgtttgtcaccctgtcatttgtgggctttgctttaatttattcttgtcttttatgcaaaacacattagccttaatcattaaaattgattattgccagtgcagcgtggtactttctgaacaactctgctgtgtaggaggagtcgccttctttgtttttcatgacagtgctgccagagcacatttttcttctattgggggtggaaagacttgtttgaaaatacaagttttgcttctccttctggtgtagctctccaaacacagaaatgcatggccggccctgttcacagtctgctcacaacctccctttctgcccaccagagaagtcttttcaaacttcagtgtgcacaacagctatgtcgggacttgcagaaaatgcacatttcccagccccaccaggtcgttcaggtccaggctgggctcagggacacatgtgtgtttcttttccactccaggccggcaggtggctccagatcccacttaaaccctacactgtaggaacctgtgcctaccctaggtctttccttgcttctttagagaatggtgccccaggacatcttcatttcctgatatctaggtcttttttcttagaattccaaccattgtcttataaaagtttgaatccatgggtactaaatacttttttggtcagacttaagatggatactgatcagaagcaaagcagtcctatgcttgattctcacgctgaagtaacccccacccctccttttgtcctgtggtatgaccacaaggcagtggtgctcagagccaggtgagtggagctgaccttacgggcagtgggatttcaggggaggaggtcattcttgtagttgcttccttcactgcgcccccacccacccatttccacagtttctgtcataaagtcctgtcacttctaccctctaaatatcttttttttttttttttgagacaaggtctcactctatcacccaggctggagtgcagtggtgccatcttggctcactgcaacctccacctcccaggttcaagtgattgtcctgcctcagcctcccaagtagctgggattacaggtgtgcaccaccatgcccagctaatgtgtttatttttagtagagacggggtttcaccatgttggccaggctggtcttgacctcctgacctcaggtgatccgcccgcatcggcctcccaaagtgttgggattacaggcgtgagccaccgtgcctggccaatgtctttcatattctacacctactgcttcagatttttgtcatattctacctagatcactggtctactcacttttttgactattcaccttatcccaatactaaatatttcagcagatatcttttaatatatgatgcttttttaaagaaaataaactacattttccactgtcaatcccagtaataaatattagtaaaccttaacattttgtagtgcttagattaaaaaaaaaaaagaagaagaaaactttaaattttttcccagtgcctaaggagctattaaaatttttgaaaactcataaacgagttcagcactgttagacatgcaggggtgtttttatggtatgtgaattgtatctcaatactgattttaaaactctttgcagtgggtcatcttgcctgggctacacacaccccactttggaataatctgacccagatgatttctgtaaccacttgtgatctctcttccagtaatcttatgtccttctgatccaccctttacagttctgactaaaatatgattctaattatgtcacttacccttaactgattcattttttcacattcaaactctttgatgtggccttaattgttacccatacttttcctgaatggatagatttttaaaaattcatttcttcgaggtctgtatttaatatatattaagtacccaataaaacaagtaattaaatcatgtggaagctattttgcttatactcattaaatactgtgtttaaggtctaaagctgtcttaaacatgaaattatgaaacaatcttttggattgagcctccctcaaactgactcaaagacaggtgttctgtattctaaattctgtaccacttcgttttgaacagtttccagtgtttagcaatttgacttctaagttgcactgcggatccctagatacatgattaccctgaaaatcatctgtctcctttaagacagcacaaaggaaacagtctaagccctcccctctgtatcttcacttaaaaaaaaaaatctatttgttcagctactgtttaccgaagatcctgtatagcaggtactatgttaggttttgtgggcattataaaaacaggtgagacaattgccttggccctcaacttctgagagcttaaggtatttgttcatgttaggcaggtaatgtctataaaccaaaagctgccacatactatctctctgctcaacactttactggatactggaggatttaagggaaggaaaaaagtgaccttttttgcctttttaagagcttgtaatcggtaaaggagataaaactcacacaaaggtcagggtatattttgtgctaagcatatgacgtagacatttaagtgctgccgtaatgcagaagaggaagaagtggtgtgatctagagtaacataggtttggttttgttttgtttttgttttttctttttctttttctttttctttttctttttctttttctttatctagacagagtctcactctgtcgcccaggctggagtgcagtggcatgatctcggctccctgcaacctccgcctcccaggttcaagcaattcccctgcctcggcctccagtgcaattggaattaaaggcgcatgccaccacacccggctaatttttgtatttttagtagaaacggggtttcaccatgttggccaggctggtctcgaactcttgaccttcagtgatccgcccatctcagcctcttaaagtgctaggattacaggtgtgagtcaccaggcccagcctgtaacagaggttttgagtggaatttggagcaaggtgagtaaccctgagtccagcctgcacgtttgagagctatagcagaggagacccggcagcagtggagtttaccaagagctctgaaagctgagttcaggattgatctgtcaagtaagacaatgtgctgaagctatgttgttgacagccctttggatttcagaaggctgttccaaggtgacttcatgatagaagttgggagaatgtggcttctgccactctgtccttttgtctgaactggagcaattacttgaactctctggatctccatcttctctaagacaaagagggtagaaaggacagtggccaggttctcttccaccttagaacatctaggattctgtatcccacagcttggaggaaaagactggtggcagccactgtggctgttccctcttcttattcccagcacccagcacagtgcctgctgtatgggcgctcggtgaggttcgcggatggataaatgtgttctctgtttcccgattctctctgccttctctctcattcttcctcctttccctcttggagccatctgcatttctattttattgtttcctttaagttttcacagcttctctctcatccttctctccatgataagtactatgtaaatcttatacttggtataaaaagataaaaagctaatttctggcccttggtcctgggctttgcaccgggggagaaggactgtaactccaagtcagcccttgactcacactgcaagatcttcaacagccaagttgcctgttcccattgcctgatcagttaagcaatactgtcttcatagagatgacattagagcttaatattttaaaggaaattctgaaattgttctcaaaacctaagtactatataaataggaaaaaaattaaatatttttttaacaattttaattgaccatataataattatatgtatttccaggtataattgtgatgttttgctatatcaattttttatggttagaacacttaaattctattctttgagcaagtttgaaatacacagtgcattattatgaactctagccatcatgatacacaacagaatttattcctcttgtctgatatttttcatcctttgaccagcatgtccccagtcccttgcccccagcctctggtaaccaccattctccttatttctatgagttcaattgttttagattccatatatgagatcatccaatatctgtctttctgtgccggtcttacttcagttagcaaaatgtcctccaggtttgtccatgttgtcgcaaatgacagaatttcctcttttttaagggtgaataaataatactccattgtgtatatataccacattttccttatccatttttcaaaggacacttagatctcttctagatcttagctattgtgaataatgctgcagccaagagctgttccctcttcttgaagaagatacggcatggtctcaccatgagaatgccacatctttttgagatactgatttcatttctttggctacatactcagaagtgggattgctagattatttggtaattccatttttagttttttgaggagccttcttacagttttccagattttcctgacagcatttgtgaggataaatgttgtatcctcacatgacagaagacgggggcaaaaaagggtctaacctatatcactccagcacttctataagacacttaccgcttcatgagggactcaatcactttccaaaaggcaccatctcttaatactacacaatgaggattaagtttcgatatgaagtttgaaggggatacaatgaaaccatagcaaagtcctttgcccattttttaattgctttgttttcttgctattgtattgttttgagttccttatatactttggggattaacccctaatataagtaaatgaaatcctaagtgacttcgaaaacttgccttttagataaaatgttgttgtatatattatgaaaggtcttactgatttaaatctattgacatataaccacaacaacttttcttgtatctagtattttcaatttcattttttaaaaattatcacttcctaacttaaaacaattttatgagtttgtggtattttctatctccatgccttttctttgtcaaatgtaatatttttctgccatctctgaaatctattttgctagtattgtcttctaaaaacagtatgtatgcatccctaaagaactgtaaaagcaaagacaaaaggtgggggaataaaaaagcaaattcctactttgtctttcttcatcgtgtctattacaaatgtagttgtcctgagtctgagaatgtgacatctccatggctgcagcctctctcccgttgttttttaccattgttttttgttgttgttgctgttgttgtttttttgtttgtgtgtgtgtgtgtgtgtgtgtgtgtgtgtgtgtaaaatgtgtatctttcttatcatgggattctagcactggaataatttgcatggtcaagctgtgtccgtaagagccacttggcatttctatttcactgttcaaaatggacagatttaaggagatgtgattttaaaatgctttattttgagcttactttattgactcctgccttatgaagccagtgaaatagtagtgaagcatttctcattgaacatcagcacttcctcggttagttcctttgtaaaaatatagcctaaatgactagccctttatgctgctgtagaaacagatttacgtaccatagcttggtaacagtgaacaaacccgagcaagccctggtattgggaggaaagtgaaaaacataagatgttgcacatattgtcattctagcctgtattcctcattaaaataagtagaaattgggatttgttcaacagaaaaagagacatttgaatattcaagattggaaagcctaaatctaaagcttttagaagaagcaaacatctgaaagcatatttgcatagatccaaagtaaaaaaaaatagaagtttgtaaattcttttaccaaattacctaaaatcctattttttcttaaataaactggattctatcattggattctaattattggattctaattatttcctaaccacaaatagaaagagtttgatttcttaacatatatattataaataactatactgatacaaatctattttttaaaaggcaaacaacccaatagaaaaatgggtccagtaatccacagaagaggaaacccagtaaacctatgaacaaaatctcatcctcattcatattcagggaaatataaattcaaatcacagtggcttatcatttcttacctatgaaattagcaacaatttacaagtataataacatcacattttgacaagaatgtaaaacaaagagaactttcagacctgctgtggaaatgtaaacagataaaaacactttagaaaacagtcatcttaaagatgcgcatattctaaaacccagaaatgccaacactttgtgacacactatagaaaaactcttgctcagattccctaggagacatgtgtaagaatgtctgttgcaacatcatttataacagggaaaaaaaatcccacaacaggaaacctgaaaacaagctaaatatccttaaacaaaattgtaatgtgtcctgcagtggggtactatgcaatgtttaaaagacaggaactagagcatacatgtagataaatcttaaaaacatgttgagtgaaaaaaaaattacaaaagaaagcctttaattagtttttatatcaagtataaaacctagagaatacacttctggttttgttttgttttgtttttttgagatggagtcttgctctgtcacccagactggagtgcagtggcgcaacctcgactcactgcagcctccatctcccaggttcaagtgattctcctgcctcagcctcctgagtcactgggattacaggcacgtgctaccacgcctggctaatttttgtatttttagtagagacagggtttcaccatgttagtcaggctggtctcaaactcctgaccttgtgatccacctgcctcagcctcccaaagtgctgggattacaggcgtgaggcaccccacacccggctacacttctgtatttttatggttacatatctttatatatgaataacactgaaaaggaatgagatgagcacgtacatgtgtagggagtttccatttatttatattttatttcttaaattcctatgttagattcatgggtgtttttcatatatcattcaatatgactttttatatatttaaaactttttttagaaaagaaggaaaatacatcatgcttttattttttgaagtggtccagtcactaaatatcatttgtcaagaagtctattaggtaatttacatattgcaataaatacacaaaggaaaacaactttgaaagaaataaaaactattgatatagtttgtcttagctcaggctgccataacaaaacactatagattgggtggcttccatagcagacatctattttctcacagttctggagatgggaaatccaagatcaaggtgccagcagagttggtgtctggtgagggctctcccctagggctgtggatggccaccatggccttccattggtgcttgcacacagtgtctcctcttataagggcactaatcctattggatatatgccccactcttatgacctcatttaaccattattacttctttagggaccccattttcgagtatagctacactgaaggttaattttgagtggacacattcaatccataacatagttgatagtctccttgcctgaaagtaatagatgagtaagaacttgtaaataaaagctacctgaagcatttttgactttcagcattatcagtatacaaataataggtttggagatgtagacgcctttctaaaatctcaaaataggtttcttttctccttcgtccttttctgggacttcttggagtgtttcattttgttttgttatagttggcatttagaaatgaatcttgtcatttttagatcactccacgtgttcatgctacctttcttgttcatttttccattcgtgtcctctgctttttacttgtcattgttttcttctgttttgatggtttttgacttggattttgtttttgttgtttggcttttaagatgtacattattacaaaagtccgtaagatattatatgtgacgctcataatttctggacacgttttcttctaatttacaacaatattatatatttgtaatttactgtccatagttattcattttctgtttatgtaaaaaattattcccctcattctacaagatttttgtgttctacaattatgttggtgttatataaaatacatttatcacctaatttagtcagatctgtttcatttgcctttacccatttatcttattgtacctgtgaaatttggataatttgcatgtgaaactagaacagtaaggagtcatacattttcaagaatgcaagagaattccaagaatgtttttaaaatgctggcagaaggttcagtaacatatctttttgggtagcctattgctaaggtgatataaatggtacccttagaatggaaatcctttgatgtaggatcaaccatattgcattggtacacggtacctataataatgctactaaggcaataattgctaaataggtagatacattttaattgacgggttgctttgggccaatcaagttgaaggaactaagaactctgctgctttggtaagagaaaagcgagatagctgcatgttttagaatatcatctggtaagcttcagagaagaaatttttcttcgtagctctgcttctttcaaaaaggaaaaaaaatatgcacatagacaattacaattcattcattgtgatggatggaaaagctggcagcattgctgagtgggcatgaaatgggaaagccaaggtgtgcagcttccatgctagctgcttaactgttcagctggtgacatgcctgtcagggcatctcttaaggcctggtcccaactcaggggcatttacacctgataaagagctcggaagccatttggttttatgacaagggacctagttaaagaggttggccttgattgccatcccgggaaggaatatatgaaatatgtggacaggggcgtgagaaagctggaaggatgtggcagcagaggcacattgggctgttttagtgaattaaagtcattcagcacaggggattttttaaagtatgctgtgctttgttattgacttgttttttttttgaacgctaaatggcatcatgatttcctgcaggaggagcaactgaagtcacatgaaagtaagctgaagcagatcaccaccgagctggccgagcaccgctcatatccccccgacaagaaggtcaaagccaaggacgtcgatgagtacaaactgaaagaccactatctggagtttgaggtgtgttgcacccaaatgttagtaaatgctgatttctgagttttcttatgatctgtccatgaggcggtatctttctttgcagtgtcactgagagaggcgtgtcttgcccctggctctaatttgggagctcctggcaaggtcatggtggcccctcttgtttgtgattctgtttaagtgccaagcaaacatcaaagagtaacctgccagtttatacacttaaaagtaaatagcctgcctggttggaatagtgtgcgcccgctgtgaggggaagaaaaagaacagtagagggacacaccagggtggacagctgctttctgtatccctgtgtctcttccggcagaattggagtcaaaaaaagcacaagggaggaaatgagccacatagttgatgtgaggcatcagcttttccctgcacattcttgctgttcggcaacactatgcgtttttcttcttgtcacccactgcccttcagaagggggttgataaattaagttgtggcacatccatctatacagtgagtgtgcttattaaaaagaatggtgaggatccatatgctatggcatggaaaagtgtaaaatttaaacccaagttgaaaacagtatatttccaaatatttccatggctcagttttcttccaaattaatgtcagggttagagtcccttagcctctgccttcagacatttaaagtgtctttttatttttaaagtaggtagcatgcaatacaaaataaaaagaattaattatcgactaatttgacctgttgttttttgtttttgtttttttttctggtgggtgtgctgaatctgcctttagctgttctttttcattgtagctctggccccttttacttctcattgttcctctcctttgttttcatcttatctgatttcctcctcaggcttgaaatttaaaatcttctaagtgtccacatcctagcgatcagtgtctgtggcgtctcacacctgtcccttccttgtattgctttataactacttcctctgctgagccctggctttctcctctcactccgctctccttccgttcatcctaaatcctttggccggttgtttttctgaggttcaacccagatgacggcattcctctgcttgacagctgcctacagcttccccgattcccctcccccagttacctcctgaagaaagtctcatttctttcactggagaggatttggcgtctccacgtttccacaacgtccgtctttcccacactggcctccctacggtagtcacatttctgcctactctccccaaacacacgtttatacctttgttcacttactttcctctgcctaagatgctcttcccatcatcttcatttctgacagtcctgttcgtcttttgaggtacagcccaaattcctcctatgaaaaacctgatccagatatactagctgggattcatctgtttcagtacttggcacaatttttttaagctgaagttattttcatctgtctttgttacctgtagcggattccgtaatacctccccctacccaaaactatgagcctaagttcatttccaggccttgctatgtgtgcttgctgaattggatacaatttcatagaagccttaaaaagtctctgagttataatatttctgttatcaaatgtagcatttgattaaaaaaatgacacttccactacagttccatgtactagttttcttcatggtcaagcaaatccttgctctgggcggagaactctactaagagaactatttattttggtaaaggtaaacgtttcttagcaaaaaccgtagaagccttaccagcaaaatgcttgaaaaaataaaataaaaaataaaaataaaccaacaacaaaaaactaggcagctcatctttccccaggcttgttcattcttgggaaatgggagttctcaaaaagcaatcattattcttcacacttctgaagtggctttaagccataggcctgttttgtttcacacaagctaattaaatttcccagcacctcagtccctgcttccagcactcagcacctcgctggagcccttgatgccgaaggtggaagagcctgtccccaggaggtggggggtggctgcaaggccatggaaagcttgccattgctaggagccctccctacttttgagtcgacagcgctacctcttttctgaaaatgtaacccaccaagagccagcattttcaatccctgacatgaagttagaccaagttttgcagggattaagtcttgctttcatcaaatcgtcacctcagcgagcttgcagactgcgttccaggactcattaaaatcagacccatatgctaatatgtcaagcaggttgacttgtctgtcaagctccttcacctgtgtctatcagaaaggcgcgaggatagctgacttggtacagctaatatttatgtcatgaaagagggaaaatttcagctgtcatctaaaaggggttttgtataagtagtgctttttaagaagtgaacaattgtttttcagtaatttaaattaacattgaagtcatatatcatattgagtccactttgctattgttgcagccaccggaatttttctctcgtgagtgcttgcagagagtctttgcacagcatcctttgcttcataagcagcattccctgagcaggccgcttcatagcagatataagagttattgaccatttttcccagtttctggaacactgactaattgacgcacgtttgttgacaacatgcgtgaaattttattattgtatataaaagataacatcagaggaagtaattctctgagaaaccttagtattcattgttttaacaggaccagaagctcccatgaaaacaaacctggtgactgttctcacccaggtgagagcagacagcagtgtctgcagttcagtgggagcccacagatgggcagtgacaggaagaggagctttaatcaccagggaagatcataggcatgaatgggtgctctcacctcctcttatggtgggtcctcctcaacagggcctcccttggtttcaaagcaattcttaccattttcacaagtccttggtaaggaaaaatacttttattttggcagaatattaagctgttagtaataacaccaggagtgttactaattgtatgcattccagttgtttaaatcccaggttgctttgagtacaaacagtgcttcatggtgagccaaatttacctctctttctatgccttagaaactgtccaaactctgactgacagtaaataatcagaaattctggtaaatacagggtttaaaaaaaaatttacagagagcaaggaaacttccatcttagcctgttagaaaagaggttcacttttacttaaagcagcaaactttactcagaatgggctctcttcattgacttaactctaagcgaagggatgttactgaattggtaacctccaagctgtggtttggaatctaatcttacttctaaaagaggctttaagcatgacaagtctacattgagaaactcaccatcatttcccaatttcaagaaataaatatcagaaatagccacatttccttataaattaacttttttctattttattcagttcccattttacttaaaaatatttaattgatccctgtgcttctagtatattgggaaacagatcaagttctggggcagatcgatgttttgtgtcaatgtaaaagtttacaaggctccaaacaaagcacagttggttgagctgttctggaaaacacctgggccccttaagacacagcaccattagagaaattcccttgacagcaatgcagttggccctaatgttttggttttatgtttcttcagctttaaaaacaacagcaactggaaggagatgacgctttttatttcaagatatttttcctgcaacatttaagatgttacagatgcaacgtttaagatgattacagatgttaacatactccttaaattaagctggacctgagtagggagagggaaaagatacaccagcccaagcctattaaatccatgactgggctacaagagatttactacaggggaattgctgaaggtcaggttaatagctggctttcaggtcattgtaaagcctgttagaaaaccagccgacgcaatgccaatgaattgtatgttgccagcccacctaatgtcaacgtgttttctttggccaacataatactgtatttgttttcattgtaatttaaatgcgtttaggaaagacaggtcttgtccttctcaccattgcctgttattaatatatcacatctgataactttctacagtaagtgtcattgctctggtccctgaaggcttttgagtttgcaaaccctgtactagaggctgcagccagttttatatgtattaagtattagttagatctttgaacatgggcttggaattaatagtcccttcatgcttggaaggaagatacttctcggtatatgtgttttcaggttccaatccagcaggaaaaaagagaatgtccacttccctcatgactgaaaccaaagacttagaataaaggtcacttgacttaatgggcttgaattcagctgaatacccactcctgaattgcgacccagagtagcatatgcttatggcttaaggcagttagagcccacaccaaccacatggctaggaaattcaattttagaaacaacaaatgtccactataacaaaacttataaatttcttgggacagaatattttcttaaaaatctaggacattcttgaagcatgatgcacctttttctgaatttctaattcttggtgacatttaaaacagcatgattccttccaaaattgatatatgtgcaaaaaaagaatacattctattcaaagtcattagggaagcccataaccattcatatctggaagcacagataatataaatttcagatagtaaacctttcattttactgttgagtatcttgttgcatagtcagtagcgttgggtagtttgatatatttcctttggagaacactttctggttgtgatcctagccttattcctcagatggtttatttttatttgtcaacattggggaagcaattttcatagtaggggccattatctaggtcacttttgctttcacaggagcagtgcagaggcatatctcaatacagtgccaactgtcacaaggcaaacccaccctctgaaacaaaattttctagcaattaagctgcaagtggtctggatcataaaagtgcaaagatagccattatttcccttggtcttcctagcgaaagcaagggagaaattctgttaaactagttaaagaagattagtagcaaaagtctcaatcttagtaagtcagtctagcgtggaatcaaatgctatctcctttacagaagacatgacagaggtgattatacatctggatctggaactgagatagtgtaggttaatagaattattgaggaaattgaagacttttctttttttcgtgggatactaagtacagatggttcccgacttaagatggtttgacttacaatttttcaacttgatgatagtgcaaaagtggtatgctttcagtacagtttttagtatattacgtgaggtattcaatattttattataaaacaggctttggggttagataattttgcccacctaagttaatattaaatgttctgagcacatttaaggtaggctgggctaagttaatgatgttcagtaggttaggtggtgtaaatatatttttgacttacgatattttcaacttagaatgggtttatctgggatataaccctattgcaagtcaaagagattctgtattacaattatgagtcaaaagctagagatgtaagatcaacagtttataccctgagtccagttaataatacagacatgatccttgccttgtcatttggaattgcattttgtattacataatgaaagaggactaagagctctgaattttaatctttaaatgataacagctgcttttgaagagaagcggagcctagcaacaggattctttgagccacatttttagtagatgattgcaaagaattagggccattcctgagaaggaagaataagcagccaatcatgtgatttgaaatgactccctgtccttaaatccctccttcatcaatcatttactgaaatgcctgctctgataagggtcactctattgggtaaaggtattatcttcaggaaaaggacaagaaagctgagagacaaaaatcataaaattagaaaaaggactagattgggaatccattttagtcttgtaattggtgtatttggcatgaccttatcctttctgaacctcagtttcctcgtcatagaaatgagatgggattgggtgaattagctgataagatcccttccaactctgtatttttaggagaatgacacattaacagcaatttgttttagattatgtcaccttcacaaagatttctatgagtgttaaacataaaacaaaaatatttcagttcaggaatgtcaggtgatatagatcagtgccttccattagaaataaatgtaaaccacctaggtgtgaatttaaattttctagcagctacatttaaaaattgaaagaaacaggtaaatagggtgacatcagcaagatggcagaatgggagctttctgttgtcgtctccctgcagaagcattgatttagacgtataccacagacaagagtacatttgtgggaatccatgagtccagtggagaagttttagcacaccattagattataaaatctgagaatagggccaggcgtggtggctcatgcctggtaatcccagcactttgggaggccgaggtgagtggatcacctgaggtcgggagttcaagaccagcctggccaacatggtgaaacccgtctcaattaaaaatacaaagaaaccccatctctgttaaaaatacaaaattagccaggtgttgtggcacatgcctgtaatcccagctacttgggaggctgaggcaggagaatcacttgaacccgggaggcagaggttgcagtgagccgagatcatgccattgcactctagcctgggcaataagagtgaaactctgtctcaaaaaaaaaaaaaaaaaaaaactgagaatagacagaataatgagtataagaagaacagtttcactttatctatgtcacccctacctcaaggcagaaaggtcactgccaagagagccccctgcaaccatgacctgtgatttcttccactggggaaagtgggagtgtaatgagtgagtgtctggctccctgagacgtgtaggatgctgcctaagaggctaaactgtttgacatcccactcagaatattaaggcaaccagcacagctgagtggttgagaaagattgaaagcagggaagagaggccatggaggcttctaactactctgtagacctccatcagaaagttctccccaagctgcatgggatgcctcacctacagatcctttcccccaggtggtccacaggcactccaaatgctccatgcacctcacactcccatccccaccccaagccagctcccaatgcatgcactgcagatagcaagtgcaaactacctgtcatacagtcactgagctcaattcggtgggattcagagagggcacacaaatttgagcattagaggacactggccaagggcacgcaaatgggaggctctcagcactcagccttgcaggatcaagagaacacgtacagtgtaagaattacccactaattgaaatgagaagtatagagtagatatgtccatagaaaaggtctgagagagcctcaaaatccctagcttggctgtttggagaaagtattcctcacccaaagacagtaaagactgaagataactgcttcttctaatgcaaaaacagcagtgcaagacgttaagtaacacaatcctgtaaaaatcaaaaaataataataataatattctagtaaccaatttcaaagaaatggacatctatgagttgcctgaaaaagaattcagaataattattttaagaaaactcagtaggccacagaatacaaagataagaatacaagagttcattgattcctcaatgaaatcagggaaacaatacaagaacaaaagttcaattaagagaaattatttaacaacccaaacaaattctggagctgaagcatatactgaatgacattttaaaaatgcaatagaaagtgtcaacagcagactttcttatgcagaagaaagaagctgagaacttgaaaacatgtcagttaaaaatacctaatcagatgggggaaaaaaggaaaaagaatgaaaaggaagggagaaagaaatctacaggattcatggaacaccatcaacagagccaattgctgcatcatagactgtaataagggcaagagagggaacatggcagaaagcttatttaaagaatacttatttaaagactgaatacttcccaaatctagagaaagatatgaatatccaggtacatgaatctcaaagacctccaatcaggttccacccaaagaggaattcaccaagacatattataatcaaactgtcaaaaattaaacatagagaatcttgaaagcaggaaagaaagggagttgagaagtgatgtctgcaagatggcttacacatacctgccacttatgcccctcacaaaaaacaactgaaactcaattagagtgtcagagggaaagcattaaagtgtagcaagagagtagtgagattccctgtagtgttcagaagcccaggaaggcagcatagtgagggtgatggggcaccctgcctctgccagctcatgttccctgctgagattagcttggagtcaagagggactacccccttgaggggaaaaggtaagcaaaagatccccaccagcttccattgccactgaagagacctgcagttcttactacaagagtataccacagccgcagcaagccctgagcctagtttggggagctgcctgtagttcacacagctacattgcttcagattaggagcacaagttgtgcatccctcactttaccctctttatgtaagctaccatgatatggcaccaccttgaaaccagatccactgctagagtgtgtcctgctctgagggttggtagcctctgtgtgccaccaatcttgggtctccaccgtcattccaccaggcttacatgggtgggtgcccagtgctagggcccaggaacaactgtggactcagatcctgcacacgagacaaattaatcccaggctggctgaattaatgcaagctcctgcccctgtctagagaaacagcccagatgacccaccaaaggcatacctgctcttgagccagcagaaccaccatgttctctcacctccagctggaggtacaagccagcaaatatgtccctggcattcttatccccgaaccatggagcagttatagcctgtgcaacttatatgtggaatctaaaaaactcaaacacaaagaagcagagggtagaatggtggtcatcaggggttgaggtgggggttggagggaaataagtagatgttgatcaaaaggtacaaatgtacagtcataagatgcataagttctggagacctaatgtacaacatggtgattgtatttaataataatgtattatgtacttcaaatttcctgaggataatagatcttaaatattctcaacataatgaataaatagatgaaacaggtgaaattaattgtagtgagattttaaaatttttacattatatgtccaaaatattttacattcttttttccatattaaatcatcaaaacctagtgtttgttttacacctgcagcatagctcaatccagtctagccccatttggcatgtctcatagtcacacataacttatggctcactgactccttgggttggaaggcgctttaccaagacaagctcaaaattggacatggactggtaagatgactacttatgatacttcccatttaaaggatcacttaaactggaaattcagaaagtttaaaattacttcaaggctgggcacggtggctcacgcctgtaatcccagcactttgggaggctgagacaggtgggtcatctcaggtcaagagttcgagaccagcatggcgaacatggcaaaataccttctctactaaaaatacaaaatattaggcgggcatggtggcgggcacctgtaatcccatctacttgctgaggcaggagaattgcgtgaacctgggaggtggaggttgcagtgagccaagatcgcaccattgcactatagcctgggcgacagagtgagactccatctcaaaaataaatgaataaatagactacttcaggtccaaaaggaataaataaatgtaggtgatgaaatgtcttaggagatcactggggaaggtagtttagatcatagttccttcagctgctcctcaaatcacactttaaggatttcctggaagaactgaccctgtcccattaagactggcattagcccttttggagctgtgagtgtgacacacaagctgacatggagaactctgggaatgtgcttctgagggatacccggtatgacttcggggaattccagtacaatcagaaggaaaagcaaagtgtaaaccaaaagattaaccacgtgccctatattaaaatgttgccataacaagctaccttttttgttttagaagatgtaaattacatagggaaaaacttaatgagtgacaaacttttatccttaggcaaaatttagtctcttacccagatagcagtacctctttagcccagattacttatcttgggtaagtggaagcttaaccttctatccttgtgtttcagaggctaatttttttttttccattttgttgaacaacaaactcggtaatcccattaatcaaatcagggtgtgttttcttttttaattttatactcagctatagtcaaaaccatcacaaggccaagctgggtgggacctttggaaacagccagagccagaggccttgtgggtggcagatcttcgtaaggttgctctgtttgtggtttggaaccggacaatttatttcttgagttttccacctagaaaataaaatgtgtggtattttctaagtaagctttgtagacttacagaatgttcattttagtttcaaaaaagagatgaaaagctgaatacttatacagactgagtttaaagaattttgagagctagagaaacagtgtaaagaatgagagaaatcatagtattttaaaatgagttttcaacaggaattgcatactcttcttaacaactcatatctccttcttcttctccacaaagacaacagtgttgttattcaaaggtaaaagcacctgctttctactcctggtcttggcaactggttggaccctgaggaaaggaatagcagggcctggaggtggggagcgtctactgatggtcactcagctctccttcctctctgaagggcctgtccaggaaactccgtaggggcactgaagagtaagatagagctgagtccacagtcaagagcagattcctatgagagcttcctggggcgaggtgtgggaacagaatgcagacaaatgaagttctcagaacactttctacagacccaggcctcctggactgtgctagtgttgagctctgattgtaccattatattaaaaagtaagctttttaatgtttaatttttaaaaaaatgaaagtcacagagttcatttagagagcaatagggcagaaagggagaatgaatcaaaagaacggaattcacactttctttggatttcccagaaagccacgaacacgaactatataaataaaaatgtgtggttatttgctatatttaggcagtaggttactactgtactctgaagcctgacatgggagtagcatagggaaaagaaaaaaaaaaaaacctgaacattttctttttaaaaatgttatttccagcatagctttcatacaggaactctgttttgaatgcagatgctttcttaagtcagtaggtagtggtgggtgggccacctggtcaaggagagtctctgcaactcaattctgccatcatctcgtagtacgcagaagggagatgagcagtccttacttgaataagcagttccttcagaagctccttgttttgtttggtttttttttttttttttttttttttttggtttgtttctttgttttccattgtagagatctaggagcaaagtgtattgctgtgtacatgagattattgcttttctgctcattttgtcttaagatggccttttgccctgtctgcatgagaaaacgaaatgtaaggaggatatgtattcaggatttggttgctagagcagtgaggtctgaatgcaaataggagcagtcagttaaaattgcagcccagctgtattttcattcaggttgttactatcgtattcatgtatcagaggtcaaaaggagatattattctataaaatggtatgcagggctctagagagaaactgttcagtgagatccatgtaaatatatgtgtggatatgattaaactacttttcaaagaatatcaatagttgtaatttttttcaaaacacaattaacattcaacccaagtagcagtttacatggtcttagacacgataatttttatttatccctcgtagacattgatgctagtgaaaagggattttttccctacatatttgggaagttttgtttttgttgttgtttttttttttgtttttgagagagagtctcgctctgtcgcccaggctggagtgcagtggcgtgatctaagctcactacaagctccgcctcctgggttcaggccattctcctgcctcagcctcccgagtagctgggactacaggcgcctgccaccacgcctggctaatttttttgtatttttgttagtagagacggggtttcaccgtgttagccaagatggtctcgatctcttgacctcgtgatccgcctgcctcggcctcccaaagtgctgggattacaggtgtgagtcaccgcgcctggccatatttgggaagtatttttacagataatcgaagatcagcttaataaagaaatacagcaaaaaaatgtaataaggaggggttacacactgaagaaagaattttacttgagtagacaaaggcgccattaaacacttgagttgcctttggctcttggtggtcacaaaaggctttatcaaaacagcaaattttagttaattaagagagagagctcactgaatgggccaggtccaagaaaacggtatgtagattcttgtcagcagagatctgccattgcagttgtatttggtaaaattccatcccaagttatttttctgatagtggaattatattatgcttacactgctggaactctatttaccctgttggagcattcctaaggaaggaagctgagtgtggggctctgaaattatttagaattgacctgagaatgaatctgcagagacaaagataaaatctttaataacataaccaaaggtagcaaaactgaccctgaggcacgcatttttctggaactgtctttgtccttgtaaatgaaagacacatacctgaaagggctacattatgaagactaaacaacaatttcagagaatgaattaaggccagtcttattagttagaggcattgtcaacaacaggctacttgactgcaagactcttctttttaccgccaccatgctttccatgggctcattattaaacatcccatctcatttttaatgtgccctatctggaactatgttaatttttgtgtagtgattactttgtggcctgaaattatattagttaaaacatattgttgctgtttcagattcccttttctaccatctggctataaaaaattatcaaagcgaagatataatacttgaatattgttattatttgtttagtaccaacagcagattccgtcctgaattcatgttgatgaggctaatatcctctgacccagagaacttagaatcttaggttagtatggaattatgtatccaaaggtaaatgagctcctgatactttacatgtcaatttcatgtgagaatgatcaggcaagtagattccagatataaataatccttgacaaatccttatctttttaatgtatgcttttagaagacaaatgtagagcattctcttcatgttgtaatgaattgtaatgagacctagtaattatccaaatgaggactcactggagtccacctacagtggtccagtttctcactttattttgaagctcacagtgggcaataaagtctatttttcatgtactactacgtaagagattctcagggccgaatgaggtggctcgcccctgtaatcccagcactttgagaggccgaggcaggaggatcacctgaggtcaggagtttgagaccagcctgaccaacatggagaaaccccgttctccagtaaaaatacaaaatcagccaggcgtggtggcgcgcatacctgtaatcccagctacttgggaggctgaggcaggagaatggcttgaacctgggaggcagaggttgcagtgagccgagatcgccccattgcactccagcctgggtgacaacagcgaaactccatctcaaaaaaaaaaaaaaagattctcagaaaatgggtctatgttttatgaacctcaaaagtgtaatataacctacgtttctctctaaagagagagaaaaagccccagtcctaagcaaggcaggctatacctcagtgcactgttgaggatctgacacgtgtggcatcttgacaacagaggtcaagagaatatgcagtggaagtggacaagcctttgtcatgtggtggcttatgagcttcaatactgacagggtcagaccttagcatttttgtgaaaaacatcattggaacggtgggatactgaagataaaggtgtgttcccagaggatcctgaattaggaacacatcaggcatctgccatcaacgtgggtatccgtgttatttttctttttctggatttgccatattacgagttcaaaatatattttctaccgtgtatggaaaaatgtgttcctcctctttctgttcatgcactcagtggcgcttattccttgtccactgtgtgttcttggccctggggatatattagtaaacaaacgcaaagtccttaccctcatgtgatggtatctagtattggggggcaaaggaggaaatcaaaaggtttttttttttttttcaagtaaaatataaggctgacagatggggagaagtgctaaggaaaacataaagcagtaagagtaggtgttccagttttagattttgatggccagggaaggcctcagtgtcaaagtgatgttaaagtgcacacctgaaagaggtgagggaggggagggaggaagtcctgtgggcttttggaagaagagctttttggacagagaatagcaagttccacaggtcctcgaataggagtgtgtgccatggaggcagattcaagcccagggacagaactgagagactgggccacgggaaaggggtggcccatgggttttctagggcattttaaggattcctggttgagaagggttttaaggatgagaattaaggatgagaaaccactggagtactttgggcagagctgacacactctgtcttgtgttttaacagggcagtgtcttttgaaaggagtgcacgtggagggcaaggagggaacagggagagcagtcaggcgactgtgggaggaacccaggcgcaaggtgatgagctcggtccagactagaaatgggagaggtactgagaaatggtgcagttctgaagatagatggacaaaacctgctgactgaaaggatgtgagacattagagaaaaagaagagtgaaggagcaaagcttttattgtcaaatttccttcttcaccacttaagaattatccctaagctttctccctaagtactagagtgctaatcatttcctagaacctgaaagtggttacagacacaggcatacctgagatactgcaggttcagttccagagtattgcaataaagcaaatatcacaataaaacaagtcacccaaatttttttgtttcccagtgcatataaaagttgtttatagcatacagtcatccgttaagtgtacaattgcattatgtcttaaaaaacaatgtatgtaccttaattttaaaataccttattgcctaccaccttctatcagaatagcaaaagaagctgctttcataaactgtcctagcagacttctacttacatgtcaggggccaaatctaggccacagggcagcagtggaaactaacagagacaagggtcatcacgcctgctttaaaccataattcctctcatggggctgggcacgctggcattcttaataaagcgcacagttccattagtacgaaagaagaggctgttcaggaagcaggaaacaccgtctgccgcaatatgattgatgagcttcttgggtccatgatgaccacttgaacactgatcattgttttcagtctctgagctggtgtgtcaaacctttaaaaagtaatttactggccgagtgtggtgcctcacgcttgtaatcccagcagtttgagaggccgaggcaggcggatcatgaggtcaggagatcaagaccatcctggccaacatggtgaaatcctgtctctactaacacaaaaaaaattagtcgggcttggtggtgcacgcctgcagtcccagctactccagaggctgaggcaggggaattgcttgaacccagtcggcagaggttgcagtgagccgagatcgcgccactgccctccagcctggagacagagcaagactccgtctcaaaaaaaaaaaaaaaaaaagtaatttactaatatacttcttgctgctcctttactttttcttacacaccagctttcatttaaaacttaaatttcacaatcggtcttaggaaaaaagatgcaaatcacatcttctctgaaaggaagaaaggaaataaagtctccaaatgatgctgttgcatagttaagaaatatgaccttcctactgcccagaaagagaatatgaggcgaaatcaatgaagagagaaatttcagttatgtttcttgcccttgctctccagagcatcattcagagttatttttctttattctgagacaattttattttgtcctcaaatcctctggatagcatttacatatgtggttgagtctgtaatcctagagatacttggctaaaactaatacctgctggttagtcctgaagttaaagttacgttttcctaaaatgttttgaagaggtatatttggtttggttcagtaaaatctagactcagagactggtaaaatgcaaagctacatttctgggttttgtaacctgtgtccctataagccttttttaagtcagaaatggggcacggcgtttgcaaactcatcaaccctcgaaggcttccttaacagcagggcaggctttgttttctggcccctctcacccccttttttctgctttgtctttacttctgatctgatgactcatgcactgccacacctctgtgctgtgccttttgtttgttgattgacacactgatgtaatttatttaagacaatagctttgcagctggagctgtaaaatgagtggatgagatggctttccttcatgtatttttcaggtggattttcctagtagtatcactttattcaaagactactggaaaactgtccctatcatcttttctccttttgtcccctttcaagtgatctaaacaatttttcttcattctcttttcattgtgtcaacgctccagcttcatgaaatcgtatgccttacgctggtttcctgaatctatttttaaacttacctttagactattttaccaaactttgtttctgttgggggtagttcttttctgttttttaatcttgccaccaaggcagtttaggagtagattaattaataaattcataaaatgaagaggcgtttagaatctttatgtcctgtggatattatcttgttcagtcctctgatttcatagtgcatctactgatgggtgatactgatgacattttttactagcaaaccttatgaaactatcatgtggccttctgagataatgcttagcatgctattctgtattttgttacttctttattgaaattggaatgtgtgtttagtaatgctttaaactgcaaataacaatacttgataaacagtggtttaacccataggatatttattattcatatttaacatgattccagaggttgtagccttagggttggatccagctcatcatgtcaacatggctctctccgtctttccatttttcctcaggtgcagcatgttgtcctatttcctcatacctactgcccatgtcacggggcagcagctttaggagtcatgtccatgttaaggagggaataagagtaagaggctaggccacgtgcagtggctcacgcctgtaatcccagcactttgggaggccgaggcgggtggatcacctgaggtcaggagttcgaggccagcctggccaacatggcgaaaccccatctctactaaaaatacaaaaattagctgggtgtggtggtgtgcgcctgtaatcctagacacttgggaggctgaggcaggagaattgctagaacccaggcggtggaggttgcggtgagctgagatcatgccactgcactccagcctggatgacagaatgagactctgtctcaaaaaaaaaaaagaatgagaggctaacaccagtgacttctccttaaagtctgtcccttttatcagaaagcaaaatctctttcccagaagccccccaaaagactcttccttacgtcttactggtcacaatatcacatggcccaacttagctacaagagagactgggaaagtaagtatctctggttttatcagtctttgtagtgaaaggcacatgagagtagaaggagttgagaatggcctttgactggccaaacaacagtgtctgtcagaggagtcatcctaaaatctatatacatataatctatattttcatatcaatggaggtaatatagcttaagagccgtgggttttgaactcagattgccttggttcaaatccgagtttcatttcttccttactttgactttgaacttgtctttgcctttgttgccttaactgtaaagcagggatggtaagttatcagttgtgtatgaatattgtgtgaatgacctgtgttaagctgttggtactcaataaatgtcatcatcggcaaccagcgctcacaccccacttgaatcctggccaaccccagaacatactgaatgtctagcagctttttcccattgttaaacgaagcagcttgaaaaggtagcacttctaaattactaacttaaaactgacacgtacaaaaccccaatctgactagaaaaatccctaagacggatgtatagtcaaaacagaatttgcctgcctttgttgggacagtttatatctgacatgttctttggtttagaaataaaacactttaagctttctataaattcttcatgcgttgaggcaggatggtggaatacttactttaccagaatgtgtcaaattaagaatctgagacccttctctaatttgcaacatatatgatagttctatatattgattgggatagaaactggaagaaaaaaaaagtgccagagccatggaaaaagaaaaaaaaaatcttagatatccaagagacggaggaatcaaggaactgtttgaaacatagtaggtactcagtacatagttggtaatgaatattgttgatttggaaaagcatcagaaaataacttgaaattctgccagcttcatactgttcatagcagcacctgttcataataaccggagaagtgggtaatccttgcagaaaagcaacggagggaaacccagagcagcttctagaaggtggtatggtctcataggggactgactgtccaggagattagccacggaatggtccctcaaggcaagcctttgtagggttacagggagtcagaaaaagagtaaacaaccatatccaagccagtttcttgtgaggcctggactacctggggaggctcaggtgactttggtacagagccacaagagccatgcagccgccgaaaaccagaggtgacagctcctccaacttagacccttctcatgcctgagtgttctagattcatggtgttccatctggtagccagcaactccaagttgacattctgtcagaatctagaacaaatgagaactaaaattctaacttaatttcttatctacataagacagtctctgtagttgcctctcatgtgcccagtaagtgcccaagtaatttgtcagtttgggaaatgaagcgaagtcttcaacagccattcacactctccaggtgggtaatacacaagtgtgctgcacacgtgcattttgaacagttttctgactaccgttgttctctggctttgccttcagaaaacccgctatgaaatgtatgtcagcattctcaaggaaggaggcaaagagctactgagtaacgatgaaagcgaggctgcaggactgaagaagtcgcactcgagtccttcgctgaacccggatacttctccaatcactgccaaagtcaagcgtaacgtgtcagagaggaaggatcaccgacctgaaacaccaagcattaagcaaaaagttacttagagtccatctgcggccaggaagtgctggtcatggagcaaaatagggtttttcaagatctttctggtaatccgtgaatatatttaaaaaaaaaaagtctgtgacaaaacggtgcattagtaattttttctattgtatatttttgttagtttctgtacagattgtctttgctcttgatttcttttgctttgatgatttttgcaacttgatagctaatgcaccttttctgtgaggaggaggggatcgtgatttcagaatgaattatgtatcccttctcttttggttttctcttgtttgcagtctgctcagttgttttatgtattctcatatcaactgttaaacttttttttaaggttaaagaatttaatccattgtgaaacacttaactggacaaactgtagttttagtaaattctagctggagttaatatacgcctttatatgtgaaatcttgcccagtcacagaggtagaattgagcactcacagatgctccagtaagaatcacagtgctgggaatctagttgctccaatatgaggcagcttcatgtgcagcttagcacttgttgttgagatcggaccctgctggaagcagggaaaagaagcgtgaagatcgtaggattgagaacttagggaagcacattagcttgcttgaagtgctgattccatttcagccaagcaagggaaagaggaagtggagtcattttgcctttgaaggctgaggaaagattgatacccagttaattttgtttgctaaaggatgggggcaataatcggcccttgaggagctgcagcagtaggcatgtgctcagtctgcaggaattgttacctcactcccacagggtctagactagaaatccatcatctctatcgttgatatccttccatccaggaatagatttttcttactctacatatgtgtgtgtgcgtgcgtgtgtgtgcgtgtgtgggcatggggttgtgtcctggttgtgatattgaggtcttccttcctaacaaattaatactaaaatgaaacagcttttcttgtgtccttaagacaaaataaggaaggaaaacgtagctgcagttgtccacgatggatattggttctttaaaatatatctgaaagtagtagtcagaatgaattatggttggaaaactgaggaatcttctggttgcaggtgcaaagtgactttgtttattcttgtctcagtctccttgatagccacttcactctgctactactcaactttctcctaaaaatacttcatctattttcagtcctttctttctgtctactcaaaatggttctattaactttgcagtcatgagcttgttccagttacagtccctttgaagttcagggtgataaacagaatattcttctgtagaggaagagaaaggagtgaaagtttagcccactgagacctagagctttgtgatttcctaaccttgaaactctgtaatccctaaagttaaaatctccgcaagtggcacaacttcagaactaatagtatcactttgatttttctttttcctcccttagaaagtttctctagttctatagtttatttgttgaaggtactatgaccaaagaatcagctgctctacaggaatagcatggttccagtgaattagagaaaacctgctgtaaagccatggtagtgtctaagtggtatgttattatgatgtactagcatttatttacagaattatttattaacgtttacttccttcccctctgtaaatgtccatgactattgcccagagaaggcttacccctctctagggttgcagttgctttctttgtaataagtattttgccacacctgtaaaaaaaaaaacctcacttttaactctctgccttgtttgggtaaaggcagtaactaagtttatgtttcagaactgcaaaacaaacaggatagttaccaatatggcccatgtatcagattgatttttgtagcctctcactgaatccaacatatccacaagcaagttatctgtctttctacctgataatctaaattatcaggatatttgttttctgcctaaatgtttatactaagccgaggggagagaggtacctagaccatgtcatctacaagcttcagtaactaaagaaaaaggaacttccctgagtggcttgaatgtgtttgcccacagtctatatctatgtatatagaatgtctgtatgtattttacttatttaatatacattgaatggtaccttgctacagtatttctgacatttagagtagtgttgaaatactcggctagcatcagcaccactatagcactgtccgtgtcatatgagtcactaatattaactccagggacttctggataggctaatagatcattggatacgaagggctcttttgaagcttcagtataccatgtttgcatagtttatctttaaaaacaactttaaaggttcttttgtgagccaggatctcagactgccgtagcatgatgctgtccatctttagcgcatgggctgagaacacctcttccctgaggcttctgaaggttgctgtctgtcatgagtgcatgaaggaggccaagagtttatgctatgggaggaaacagtcactgatttgcctagattctgagagtctggcccatagccaaccacattttcctttgggataatttatttcctgtggcatctagccagaagaaattgaggatgtttcctttcacagctgctccaagcctgttgcccaattcacggtacaagggagcaccccttccctttcctctgaaggtacgccacccacctccgtcgcccacctcagcgcccaggagccttgggacttccttccatatgataaatcattcttcttcacgtcaatacacttcatattaatttctagtacagaaaatcttgacagctatcagaatgccttggtcatagtgttgttgcaaaattgaccatacaggtggcccatgtataaaatctgaattttaggggtttgtccccacctcgcatgctggcttttacagggaggtgtctgggattcctcattagcaatcaaaacttaattactgggatgcagagtccttactttatcgccagcccgtaggcatttctgaagtgcacttttttgaaacatcattttgctaactctcagcagtgtctaattaaactgagcaatacttttgtgaattttaattaatctcagcaaaaccatgatgggagagagtcctctgatggaaatgtagtccctggattatgtgtaacctttttattcctcttagatgcagaggatagaaagcattttttggtgcagtggtcttgtggcaaacacaagaccctctatgcgtctccaactgttatcctaatctagaaaatgaggactggcccctgggcaaaagtgacatgaggaatttactctggaagaggaaaatctgggtggctttccaaggctaagataggtttgtatttcaccctgtggccaagctacagaacttctgagattgtggaagaatttttgcaaccagcagggaaagaggcctcttactgcctaaacacaaagttacactgagcttttctactgtcctttgcctattgctccctctatcatgtaaagatctgggaaggatgagaggcagggcctgcttgtcatgagctgcactcttttctttttaactaatcattgacaattggaagaaaattgacgttaaagaagtttctccattgtcttactaacaaaaccttttgggtttcattaattgtccttgaaattgagttcctttggcatttttccttgcagtcatcagttaagcatgttgcatcctgaattcacagaagtttagctttgcaggtttgaatctctgtaatttaactcccgtggacttggtcgagttttcagcaggttgggagccacctctcttcatttcagcagtgagtcatcccttgacttttcaaatgacagaattttttccaattgtaaaattagcactgtaaaacaaagaaccaaagtggcatcctaagagttgttaaacctgaagtctagtttatgaggaattgtccaagttggagtttaaatagtatctgcttttgtctcaaagcatctaagttattctgacagaaaatggtaagtcagctttgcaggcagatgcgcctctgggcctcctaccttgctccacagctttctggccatcttgtctcccaggccatgccactgctctgccacatgtcagcaaatttctttccaccagtcttatagcatcttacatgatcaaatcatcacagaataaccccgtgatagattattgatagcaatagagaggggctttgtcactgatttttctctcagattccttttccatctctcatccataaaggaaggactgaaatccaaaggcattctccttttgtacctacagtatccagaacccacgtgggcagccttctgcttatgacaataattggcccattgcatgcagagagaatgtcttcatagagagaatgtcattaaatacttgaatctgcatgacagtttgacttgaatgcaacagcaggaaaattttgcaagttacataattgtatatacagtaggttttcttaagtctcttcggttcatcctttgtaatttgtgtgtgtatctgtagtattgcaggcttttggagactattcttacaggcagtatgtcagtcatcaaagaaaatgctgtcacctgccattgttgtatttgtgggtatttatagttgtatgtatgtaaatgcatcagtgtgtagattgcatatcagtgtatggtacatgtacatcaaaattatttttgtccttaatcagtgtgatatgaaaagcaagtacaacctcataggactgattatataatgaagttgttgagagtatatatagtggtattgttttattaaacttaaactcaaataatattttgattaaaatttttaataagactttatgctagaaaattctttgagctttgaatcaccagggcaaaaatgactttcaactaaccttgtgaatcttttgcagtgtactgtgtgcaataccaagggcatagctccctgtaatttgggaaatacagaaagaaaagaaaaaaaaaaaaaaaggcagcctgtgcagtcttagtaactttagtattaagagcacttaaagtcaaactgacaattttgggcttattacaaaatgtgatgctttaaagcacacgttctttattgttgttgtaattagtccataaaaaatatagctttcggaagaattaagtacccaccatatcatttatgtatttgtgtatgttttacgggagatcaaaccactctcgtggtgccgcatccgtactcgcttgacttggaagaaatatcacaagcactaaagtatatcagggcatcccaggattgggtactgtatcctaggtttgcagttgcagaaattagcatctagtgtcacaggtaaaagaatttcaggaccaggtttaaactttattttaaatatttttatacttaggtctctttttcctgcctctccccaaagaagagccactggccttagttgtttgagcttactgcttatattatagagtgtaaataggtaactagagactaaaattttattaaccagcatgtttggtatatttaaagcagtgactgagtgtgtttgagtgagtggctgagtgcagtgtcttttgtttaaacacactgcctcgtgtctttgtagctgattcagagagtttgaattgtggggtgggagactaacttcagctccaggctgcagtaatgtgttggtagttacacttgaggcatttttttgttgttgttaattaactctatagtctcaaactatttttgcaaatatatcatttttcctaattggttcttgacgtgcagtggactggctctgtgaatgattggcagggtcttagttttgcgagagtatttccttctaagaattattgtgatctgcagaaacagccatttgattcaaaaatcatgtagaaaaggagtaggagaagcaaaacgtttcatttttgggccttaaccatttgaaatgtttggactttaaacataaagccatggagtttataaagccaagtaaccatttgatatggataataatatctactctagagagagtatatatatgcacattgatttttaatgctgttaagatacttttgtaaaactgtaggaacaagagtaattagaccaaattgaagcttaggggacagtaaagtggttgctttccatttagggtaaccatgcatgtggttagtcctctcctcctgagattcagaaccagttgactgtccccttaggtgtataaggagaaaagttgacatgtctgggacctctgacatgtgtacacatgcttgcacacatgcacacacagtgaatgttttaagttatacaaacataagaccttaagatgcaaagagccagaatattctaaagaggtgatgaacagagggggtggaaactgcatcacagatgttttccaagggccagggtggaatctgagctctagtgtctgactttgagatgcattatatttttaacacataaatgaggggatccatatcacattctttcttgtggaccaccaaattgaaggctttcttgtaattcacaagcagcagctctccagcatctctccgtagcctgggtgaagtcccagaagctggtgtgcatcattttccaaggtggcagagctgcttgctctgcagatcattcctttgagagaggagtacaagtgaagaaacaaggaggcacttcctgtaggagcactgatgtgccttgtccacactcccctctgagctttactggtaagagagctccgactgaacatgctgagcagttgagcacttttccatcagcaacaacagcgaggatggaaatggaaaggaaccgaactaaaatgcatttccctttgcagggcagagagctaagctcttaggaatagtgttatagaaataagcaccctaacttcaattcctgaaaatgttggttaatggagagaattttggagtttcacttaatattttcccatcggtcgccataaataagtcttcaggcgctcctagaagagtcccagcccaaggctcgattaaggaccacactgcaggtctgaggctcactgctctgagtcctgaacaccagagccctgcagagagtggtgataacacatcatctctgcaaagaggaacctctcccccggccgccacttcactcaggcttctactgagcagcaaggacagcctgggtttcaaatgccacttcccctgctttagggatccaggtgtcctgatagcgtgaccctgctgaggcaaggtatcaactccgagagtgactgagtcactgagcgtggcacatgaacaaacgtcatgacaaagattctctgagtgaagttaacaccacgtattttacctttgcaaaaaacaaactggcaccctgagttctaactacggacggacgatatctttgcctccacacccagattcctggaaatggctaacgtttcctttctaggggaagggtcgaggaatactcaagtgctagcttagcagctttgttcagtccagatcagagctgttaggtaaaggcctaaccacctccctgcagtctcttatatctcaagctttaggaacccatttctaaatgtacactagcggagaatttatattgtcagccttgattaccataggacaggcagaaaggcgataatttgtatcttttaatataaaagaagcttttaacttttccagcctattataataactgagttatattcactgtggctcaaactaattggcattgtggaacatttctttaccttcaaagttttctccaccaatcatttcagttctattgcagtcctggtgccatatgtcccctgcaaattgtgaaagtaattagtgacaaaatagcagcctgctccttttcaatggcgaaactgtcggcattagcagttttgggtaagctggcggtactataacacgtactggaaacctgttcctcatcaccacctaccagattctggaaatgccgtcttctagaaaacgatggcgtttgtggtggtcttcttttgaaaggaacagtaatttgtgtggatattgttaaagtgtttaaagaatattttgacaattaagtttacattttacaattgctttattttttattaaaatagttgtatataaatattaccctatttcactgttgttcaagtaaatctaaaccttgtagacaagtgagtcatctgatatgtatagaagctgtgatatatagagtacatttattgtgtaaatgtttatgaatataattgttcctgtgtttttataagttggggatattttgttgttttacggcaacaaaatttattgcatttaaatggtttttatgtaatagaaatcacgcaaaatagtgaaggatttaaaatatgtatatgatacatgtaaatgtacaaactttagaaagaaataaatccaacaaatttcaatcatttgagggaatgtttttatttgcttatttaagcagctataataatacctttaaaaatcaaataacaccacactctgcctgcctccataaaaacacaaccgcaagccccacattgaaagatgccaccagagtggttgaacacagtggtgagaaaatcagactaacaccgactcacctccacacatttctgtgaagatttgtgtttgaacacttcagagatctgttgtcttcactaaggggctttgagcaggggaggagaaaataaacttttagaagcaatttcaagagccatttgcattcccatttatttctcatcaaggcaaagagaccatgcagctatttattgtcctaaaatgcaaatgctgatctccaaatcactgccttactctgcctggtgtgtacctttttactcttttcatcaaacctaatgttaaaagtaagatccgttgacttggaaattcaaaaataaaatgccatcctattcacttctaaatattagaaaggatgtcttatgttgggggatttggactttttgaaacaagatcactggttacagcctctccagcacaaatgaacatgatgtatggcagagatcaaaattgctatgaggtgtaaatctcaaagaaatcaaagcattgtggggattgggagagctatatcctttaccatcccttcgctttcactccagcttggaatgtgaaatgtgtctgaagaccaccaggatggctgactagtagaaaggagagctttattggccatatcagtttgcaaactcggagagtggtctccgaagtataccgaaggtcctctctcttcaaagagggaagggaaggttggtttttatgcctcacagggcctgtattacacaatagagtcatacatattcagcagtgggtttggaggaaaagctatccatatgtatgtggggagccgagcgcatgtgcaataggtaaatatatgcatagcatacaccctacgttcattttagggcaaggtgttagcattaaaatgaggtgtaatttggctcttcatgttgaaaggtggcctataggatactaagtttgtgcacagtctctagaacctgctgaaactggtttgagctctgcagtttcttaccaggaaagaatgttcgtaaggctggtcttctttccaatcagcattgtagtagttgtattaataattcagagttagaaagggtcagacaatttgtctgtagctcttagtgttagggagtttatcaagaatgtggtttttcttgtagccataggaatttaggggccgtgctagtcaggccctaaagcctccacagcagataaatttgttcccttaacctcagggttcatcttagttgataaaagagtgtctatttcagtctctcagatcacaaactcaaatacgaatctctccttgtcagctgcctgtcctctggaggtggggggttttgtatcctgttgtattctctgtattgcacagttaataacagcaccagtgggactatagagatatttgataactcatagggggaaattaaacgtagagcaaattaaattgcataaggaataaatagaataaggatacaacaagcaactctaaatgtctcatctctagatcaattctattccacagaactgagattcatcaatgagactgctcaatcactgtccatttttattgataaattataagcaataggaaatattgcagacaggcatacatctttctaatattagtggagaagagtgtgcgttctgtatgctatagactagtgaacttgatattaattttgggcatatttttagagtaaattggaagggcagcagcaattaattggaagccagtgtgggttcccaaaaagaaatcttttcagactccatttattccctattttataagactaacctgtagattagaaaaacgcaggagacaaaatatctggaccataacaagggatttggcaaagtctttaatgaaatatgtctgggcaaaatgcagaaatattatctggacgttagtagagttggtgggtgtgaaaccacttgaacgacactgattaaaggatatgtatcaactcggaagagcatttctattgtcccgctgcaaagcttgccttttggccccatccattcaacattttaattaataacttgatggaagctgcagaaggcaagtttatgaaaaatggttatgtcataaagctgggagaaaatgattacactaaatgacagaatcaggatttgaaaaaaaatctcatcaggcagagaaatggggcaaattaatgcagaatgcaagagggtgtaatgtcttacacttcagttacaaaaaaaacaattaaacaaggtcaggataggacattgtgtcgcacagaatagcgagtaagtgggaaagaaagccttcaactgaaatccatagcaagctcgatgaaagtcaacagatgatgcaccaccaaaaacactagtgccatcttgggatcttgggttacattgatgtatggcttcttttttttttttttttttttttttttgagacatagtctcactctgtcgcccaggctggagtgcagtgacgcgatctcggctcactgcaagctccgcctcctgggttcacgctattctcctgcctcagcctcctgagtagctgggactacaggcgcccgccaccacgcccggctaattttttgtacttttagtagagacggggtttcactgtgttagccaggatggtctcgatcttctgatctcgtgatatgcccgcctcagcctcccaaagtgctgggattacaggcgtgagccaccacacccggcctgatgtatgtatggcttctaaaacaaggaaggtgagtcgcagtgcccttgacaccaaggctaaccctgggtaaattgcttgagacttggcacgtacacgaaacagagcatgtgcaaaagcagcagccagggtgccccaaaaatgggagcaattgagagaaatatggaaaacgtatgacctggaaatggttaacccatgcagaaccagggaagactggtcttcaatgtcaaaatgagtctttcgtgggagggacatgagaactgtcctatagcaatctaaagggtttaactagattagttattggaacttataaaaataagatggcagctcaacagaaaggaggcatttctagtattccaggctgtccatgacaaacaagttgtcagccagtggagcagttcaagtgtgcttgggcaacctcaggtggaaatactgagaactgagtgaggctttgggtaagtggttggattattatgatgatagacaatattattacaaata

SEQ ID NO: 18 - DNA, 566000 bp, Homo sapiens; identical to SEQ ID NO: 17

SEQ ID NO: 19 - DNA, 16 bp, Artificial sequence
  Synthetic oligonucleotide
ggccaatacgccgtca

SEQ ID NO: 20 - DNA, 11687 bp, Homo sapiens; identical to SEQ ID NO: 2

SEQ ID NO: 21 - DNA, 149 bp, Artificial sequence
  Synthetic oligonucleotide
  misc_feature (31)..(31): n is a, c, g, or t
  misc_feature (84)..(85): n is a, c, g, or t
  misc_feature (99)..(99): n is a, c, g, or t
  misc_feature (119)..(119): n is a, c, g, or t
cgttgttacttcagctgaaagaggtatttcnggtaaatttttttggccagcagggagckrtttgttgactctctgtgttttacnnctggcagtgtccanctctttttccacctgctganctgaaaaactagaaacagcatcttggtcca

SEQ ID NO: 22 - DNA, 26 bp, Artificial sequence
  Primer
cgttgttacttcagctgaaagaggta

SEQ ID NO: 23 - DNA, 25 bp, Artificial sequence
  Primer
tggaccaagatgctgtttctagttt

SEQ ID NO: 24 - DNA, 16 bp, Artificial sequence
  Synthetic oligonucleotide
tcaacaaaacgctccc

SEQ ID NO: 25 - DNA, 16 bp, Artificial sequence
  Synthetic oligonucleotide
tcaacaaactgctccc

SEQ ID NO: 26 - DNA, 21 bp, Artificial sequence
  Synthetic oligonucleotide
  misc_feature (1)..(19): bases at these positions are RNA
guauuggaaguacuacuaatt

SEQ ID NO: 27 - DNA, 21 bp, Artificial sequence
  Synthetic oligonucleotide
  misc_feature (1)..(19): bases at these positions are RNA
cgcuaugaaauguaugucatt

SEQ ID NO: 28 - DNA, 21 bp, Artificial sequence
  Synthetic oligonucleotide
  misc_feature (1)..(19): bases at these positions are RNA
caacgaauuuagcaaacuatt

SEQ ID NO: 29 - DNA, 21 bp, Artificial sequence
  Synthetic oligonucleotide
  misc_feature (1)..(19): bases at these positions are RNA
uuaguaguacuuccaauacga

SEQ ID NO: 30 - DNA, 21 bp, Artificial sequence
  Synthetic oligonucleotide
  misc_feature (1)..(19): bases at these positions are RNA
ugacauacauuucauagcggg

SEQ ID NO: 31 - DNA, 21 bp, Artificial sequence
  Synthetic oligonucleotide
  misc_feature (1)..(19): bases at these positions are RNA
uaguuugcuaaauucguugtt

SEQ ID NO: 32 - DNA, 21 bp, Artificial sequence
  Synthetic oligonucleotide
  misc_feature (1)..(19): bases at these positions are RNA
cguuaugaaauuuaugucatt

SEQ ID NO: 33 - DNA, 21 bp, Artificial sequence
  Synthetic oligonucleotide
  misc_feature (1)..(19): bases at these positions are RNA
ccaggaacgugagcgaauatt

SEQ ID NO: 34 - DNA, 21 bp, Artificial sequence
  Synthetic oligonucleotide
  misc_feature (1)..(19): bases at these positions are RNA
caacgaauuuagcaagcuatt

SEQ ID NO: 35 - DNA, 21 bp, Artificial sequence
  Synthetic oligonucleotide
  misc_feature (1)..(19): bases at these positions are RNA
ugacauaaauuucauaacggg

SEQ ID NO: 36 - DNA, 21 bp, Artificial sequence
  Synthetic oligonucleotide
  misc_feature (1)..(19): bases at these positions are RNA
uauucgcucacguuccugggt

SEQ ID NO: 37 - DNA, 21 bp, Artificial sequence
  Synthetic oligonucleotide
  misc_feature (1)..(19): bases at these positions are RNA
uagcuugcuaaauucguugtt

SEQ ID NO: 38 - DNA, 21 bp, Artificial sequence
  Synthetic oligonucleotide
  misc_feature (1)..(19): bases at these positions are RNA
gucucaucuucguaguggatt

SEQ ID NO: 39 - DNA, 21 bp, Artificial sequence
  Synthetic oligonucleotide
  misc_feature (1)..(19): bases at these positions are RNA
agacggugacuuacaaaaatt

SEQ ID NO: 40 - DNA, 21 bp, Artificial sequence
  Synthetic oligonucleotide
  misc_feature (1)..(19): bases at these positions are RNA
ccaaggucucaucuucguatt

SEQ ID NO: 41 - DNA, 21 bp, Artificial sequence
  Synthetic oligonucleotide
  misc_feature (1)..(19): bases at these positions are RNA
uccacuacgaagaugagacct

SEQ ID NO: 42 - DNA, 21 bp, Artificial sequence
  Synthetic oligonucleotide
  misc_feature (1)..(19): bases at these positions are RNA
uuuuuguaagucaccgucucc

SEQ ID NO: 43 - DNA, 21 bp, Artificial sequence
  Synthetic oligonucleotide
  misc_feature (1)..(19): bases at these positions are RNA
uacgaagaugagaccuugggt

What is claimed is:

1. A method of treating or preventing fatty liver disease in a subject in need thereof comprising administering to the subject a compound comprising a modified antisense oligonucleotide or modified siRNA consisting of 17 to 30 linked nucleosides, wherein the nucleobase sequence of the antisense oligonucleotide or siRNA comprises a targeting region comprising at least 15 contiguous nucleobases complementary to an equal portion of a Pleckstrin and Sec7 Domain Containing 3 (PSD3) RNA, wherein the antisense oligonucleotide or modified siRNA is at least 90%, at least 95%, or 100% complementary to an equal portion of any of SEQ ID NO: 2-18, and wherein the antisense oligonucleotide or siRNA comprises one to five GalNAc moieties attached at the 5'-end or the 3'-end of the antisense oligonucleotide or siRNA which is effective in lowering the expression of PSD3.

2. The method of claim 1, wherein the modified polynucleotide has:
   a gap segment consisting of linked deoxynucleosides;
   a 5' wing segment consisting of linked nucleosides;
   a 3' wing segment consisting linked nucleosides;
   wherein the gap segment is positioned immediately adjacent to and between the 5' wing segment and the 3' wing segment and wherein each nucleoside of each wing segment comprises a modified sugar.

3. The method of claim 1, wherein the modified polynucleotide comprises at least one modification selected from at least one modified internucleoside linkage, at least one modified sugar moiety, and at least one modified nucleobase.

4. The method of claim 3, wherein the at least one modified internucleoside linkage of the modified polynucleotide is a phosphorothioate internucleoside linkage.

5. The method of claim 3, wherein the at least one modified sugar moiety is selected from a bicyclic sugar, 2'-O-methyoxyethyl, 2'-F, and 2'-O-Methyl.

6. The method of claim 1, wherein the fatty liver disease is selected from any one or more of non-alcoholic fatty liver disease (NAFLD), non-alcoholic steatohepatitis (NASH) (cirrhotic and non-cirrhotic NASH), hepatocellular carcinoma (HCC) and liver fibrosis.

7. The method of claim 1, wherein the fatty liver disease is selected from any one or more of alcoholic fatty liver disease (AFLD) and alcoholic steatohepatitis (ASH) (cirrhotic and non-cirrhotic ASH).

\* \* \* \* \*